US007122345B2

(12) United States Patent
Padigaru

(10) Patent No.: US 7,122,345 B2
(45) Date of Patent: Oct. 17, 2006

(54) NUCLEIC ACID ENCODING A NOVX13 POLYPEPTIDE

(75) Inventor: Muralidhara Padigaru, Branford, CT (US)

(73) Assignee: CuraGen Corporation, New Haven, CT (US)

( * ) Notice: Subject to any disclaimer, the term of this patent is extended or adjusted under 35 U.S.C. 154(b) by 800 days.

(21) Appl. No.: 10/042,865

(22) Filed: Jan. 9, 2002

(65) Prior Publication Data

US 2004/0029216 A1 Feb. 12, 2004

Related U.S. Application Data

(60) Provisional application No. 60/284,704, filed on Apr. 18, 2001, provisional application No. 60/274,876, filed on Mar. 9, 2001, provisional application No. 60/272,338, filed on Feb. 28, 2001, provisional application No. 60/260,831, filed on Jan. 10, 2001, and provisional application No. 60/260,417, filed on Jan. 9, 2001.

(51) Int. Cl.

| | |
|---|---|
| ***C12N 15/00*** | (2006.01) |
| ***C12N 15/12*** | (2006.01) |
| ***C12N 15/63*** | (2006.01) |
| ***C07K 14/00*** | (2006.01) |
| ***C07H 21/04*** | (2006.01) |

(52) U.S. Cl. .................. 435/69.1; 435/320.1; 435/325; 530/350; 536/23.1

(58) Field of Classification Search ................ 435/69.1, 435/320.1, 325; 530/350; 536/23.1
See application file for complete search history.

(56) References Cited

FOREIGN PATENT DOCUMENTS

| | | |
|---|---|---|
| WO | WO 93/21314 | 10/1993 |
| WO | WO 98/02541 | 1/1998 |
| WO | WO 00/58473 | 10/2000 |
| WO | WO 00/65054 | 11/2000 |
| WO | WO 02/057453 | 7/2002 |
| WO | WO 02/072830 | 9/2002 |

OTHER PUBLICATIONS

Ritter JK et al. Cloning and expression of human liver UDP–glucuronosyltransferase in COS–1 cells. 3,4–catechol estrogens and estriol as primary substrates. J Biol Chem. May 15, 1990;265(14):7900–6.*

Doerks et al. Protein annotation: detective work for function prediction. Trends in Genetics. Jun. 1998, vol. 14, No. 6, pp. 248–250.*

Brenner, Trends in Genetics 15:132–133, 1999.*

Bork et al. Trends in Genetics 12:425–427, 1996.*

Mickle JE et al. Genotype–phenotype relationships in cystic fibrosis. Med Clin North Am. May 2000; 84(3):597–607.*

Voet et al. Biochemistry. 1990. John Wiley & Sons, Inc. pp. 126–128 and 228–234.*

Yan et al., Two–amino acid molecular switch in an epithelial morphogen that regulates binding to two distinct receptors. Science 290: 523–527, 2000.*

Oohashi, et al. (1999). "Mouse ten–m/Odz is a new family of dimeric type II transmembrane proteins expressed in many tissues." *J. Cell. Biol.* 145(3): 563–77.

Wang, et al. (1998). "Identification of novel stress–induced genes downstream of chop." *EMBO J.* 17(13): 3619–30.

Minet, et al. (2000). "Phylogenetic analysis of teneurin genes and comparison to the rearrangement hot spot elements of *E. coli*." Gene. 257(1): 87–97.

Liu, et al. (1999). "Gamma–heregulin: a fusion gene of DOC–4 and neuregulin–1 derived from a chromosome translocation." Oncogene. 18(50): 7110–4.

GenBank Accession No. AL045768, created Jul. 9, 1999.

International Search Report for PCT/US02/00554, mailed Apr. 23, 2003.

Agnello, et al. (1999). "Hepatitis C virus and other flaviviridae viruses enter cells via low density lipoprotein receptor." *Proc Natl Acad Sci U S A* 96(22): 12766–71.

Alderborn, et al. (2000). "Determination of single–nucleotide polymorphisms by real–time pyrophosphate DNA sequencing." *Genome Res* 10(8): 1249–58.

Batt, et al. (1996). "Microinfusion of aminopeptidase M into the paraventricular nucleus of the hypothalamus in normotensive and hypertensive rats." *Brain Res Bull* 39(4): 235–40.

Berg and Heiberg (1976). "Linkage studies on familial hyperlipoproteinemia with xanthomatosis: normal lipoprotein markers and the C3 polymorphism." *Cytogenet Cell Genet* 16(1–5): 266–70.

Berg, et al. (1979). "Submicroscopic investigations on calcium oxalate stone genesis." *Eur Urol* 5(2): 136–43.

Berkemeier, et al. (1992). "Human chromosome 19 contains the neurotrophin–5 gene locus and three related genes that may encode novel acidic neurotrophins." *Somat Cell Mol Genet* 18(3): 233–45.

Betteridge, et al. (1978). "Compactin inhibits cholesterol synthesis in lymphocytes and intestinal mucosa from patients with familial hypercholesterolaemia." *Lancet* 2(8104–5): 1342–3.

Boehnke, et al. (1989). "Fine–structure genetic mapping of human chromosomes using the polymerase chain reaction on single sperm: experimental design considerations." *Am J Hum Genet* 45(1): 21–32.

(Continued)

*Primary Examiner*—Joseph Murphy
(74) *Attorney, Agent, or Firm*—George M. Yahwak

(57) ABSTRACT

Disclosed herein are nucleic acid sequences that encode novel polypeptides. Also disclosed are polypeptides encoded by these nucleic acid sequences, and antibodies, which immunospecifically-bind to the polypeptide, as well as derivatives, variants, mutants, or fragments of the aforementioned polypeptide, polynucleotide, or antibody. The invention further discloses therapeutic, diagnostic and research methods for diagnosis, treatment, and prevention of disorders involving any one of these novel human nucleic acids and proteins.

5 Claims, No Drawings

OTHER PUBLICATIONS

Brauer, et al. (2000). "IG–molecule Kilon shows differential expression pattern from LAMP in the developing and adult rat hippocampus." *Hippocampus* 10(6): 632–44.

Brink, et al. (1987). "Familial hypercholesterolemia in South African Afrikaners. Pvull and Stul DNA polymorphisms in the LDL–receptor gene consistent with a predominating founder gene effect." *Hum Genet* 77(1): 32–5.

Brown, et al. (1983). "Isolation of cDNA clones for the light subunit of rat liver ferritin: evidence that the light subunit is encoded by a multigene family." *Proc Natl Acad Sci U S A* 80(5): 1265–9.

Brown and Goldstein (1974). "Familial hypercholesterolemia: defective binding of lipoproteins to cultured fibroblasts associated with impaired regulation of 3–hydroxy–3–methylglutaryl coenzyme A reductase activity." *Proc Natl Acad Sci U S A* 71(3): 788–92.

Burchell, et al. (1987). "The molecular biology of UDP–glucuronyltransferases." *Biochem Soc Trans* 15(4): 581–4.

Camara, et al. (1990). "Inherited lysozyme deficiency in rabbits. The absence of a primary isozyme of lysozyme as the cause of the condition." *Lab Invest* 63(4): 544–50.

Canet, et al. (1999). "Mechanistic studies of the folding of human lysozyme and the origin of amyloidogenic behavior in its disease–related variants." *Biochemistry* 38(20): 6419–27.

Cao, et al. (1996). "TRAF6 is a signal transducer for interleukin–1." *Nature* 383(6599): 443–6.

Caskey, et al. (1983). "Human ferritin gene is assigned to chromosome 19." *Proc Natl Acad Sci U S A* 80(2): 482–6.

Chatterton, et al. (1999). "Expression cloning of LDLB, a gene essential for normal Golgi function and assembly of the ldlCp complex." *Proc Natl Acad Sci U S A* 96(3): 915–20.

Chowdhury, et al. (1991). "Long–term improvement of hypercholesterolemia after ex vivo gene therapy in LDLR–deficient rabbits." *Science* 254(5039): 1802–5.

Davis, et al. (1986). "The J.D. mutation in familial hypercholesterolemia: amino acid substitution in cytoplasmic domain impedes internalization of LDL receptors." *Cell* 45(1):15–24.

De Braekeleer (1991). "Hereditary disorders in Saguenay–Lac–St–Jean (Quebec, Canada)." *Hum Hered* 41(3): 141–6.

Defesche and Kastelein (1998). "Molecular epidemiology of familial hypercholesterolaemia." *Lancet* 352(9141): 1643–4.

Deng, et al. (2000). "Activation of the IkappaB kinase complex by TRAF6 requires a dimeric ubiquitin–conjugating enzyme complex and a unique polyubiquitin chain." *Cell* 103(2): 351–61.

Dorow, et al. (1995). "Complete nucleotide sequence, expression, and chromosomal localisation of human mixed–lineage kinase 2." *Eur J Biochem* 234(2): 492–500.

Ekstrom, et al. (1999). "An individual with a healthy phenotype in spite of a pathogenic LDL receptor mutation (C240F)." *Clin Genet* 55(5): 332–9.

Elston, et al. (1976). "Probable linkage between essential familial hypercholesterolemia and third complement component (C3)." *Cytogenet Cell Genet* 16(1–5): 294–7.

Feussner, et al. (1996). "Unusual xanthomas in a young patient with heterozygous familial hypercholesterolemia and type III hyperlipoproteinemia." *Am J Med Genet* 65(2): 149–54.

Francke, et al. (1984). "Assignment of the human gene for the low density lipoprotein receptor to chromosome 19: synteny of a receptor, a ligand, and a genetic disease." *Proc Natl Acad Sci U S A* 81(9): 2826–30.

Frank, et al. (1989). "Linkage of the mouse LDL receptor gene on chromosome 9." *Genomics* 5(3): 646–8.

Funahashi, et al. (1988). "Mutations of the low density lipoprotein receptor in Japanese kindreds with familial hypercholesterolemia." *Hum Genet* 79(2): 103–8.

Funatsu, et al. (1999). "Characterization of a novel rat brain glycosylphosphatidylinositol– anchored protein (Kilon), a member of the IgLON cell adhesion molecule family." *J Biol Chem* 274(12): 8224–30.

Geijsen, et al. (2001). "Cytokine–specific transcriptional regulation through an IL–5Ralpha interacting protein." *Science* 293(5532): 1136–8.

GenBank Accession No. A75965 (Oct. 19, 1999).
GenBank Accession No. AAA41154 (Apr. 27, 1993).
GenBank Accession No. AAB80953 (Oct. 6, 1999).
GenBank Accession No. AAC38017 (Jul. 17, 1995).
GenBank Accession No. AAC51329 (May 31, 1997).
GenBank Accession No.: AAC95002 (Dec. 10, 1998).
GenBank Accession No.: AAC98726 (Dec. 30, 1998).
GenBank Accession No.: AAD23572 (Apr. 6, 1999).
GenBank Accession No.: AAF52949 (Oct. 4, 2000).
GenBank Accession No.: AAF68948 (May 9, 2000).
GenBank Accession No.: AAF91275 (Nov. 1, 2001).
GenBank Accession No.: AAG09564 (Sep. 1, 2000).
GenBank Accession No.: AAG32641 (Nov. 16, 2000).
GenBank Accession No.: AAG33975 (Nov. 23, 2000).
GenBank Accession No.: AAG44591 (Jan. 2, 2001).
GenBank Accession No.: AAG45196 (Aug. 7, 2001).
GenBank Accession No.: AAH03851 (Jul. 12, 2001).
GenBank Accession No.: AAH11497 (Aug. 2, 2001).
GenBank Accession No.: AAH17476 (Nov. 21, 2001).
GenBank Accession No.: AAK33010 (Dec. 31, 2001).
GenBank Accession No.: AAK68048 (Jun. 28, 2001).
GenBank Accession No.: AAK95097 (Aug. 27, 2001).
GenBank Accession No.: AAL08411 (Sep. 29, 2001).
GenBank Accession No.: AB000509 (Mar. 25, 1998).
GenBank Accession No.: AB002301 (Oct. 6, 2001).
GenBank Accession No.: AB011019 (Jan. 7, 2000).
GenBank Accession No.: AB011133 (Apr. 10, 1998).
GenBank Accession No.: AB017139 (Apr. 6, 1999).
GenBank Accession No.: AB023190 (Jun. 16, 1999).
GenBank Accession No.: AB025413 (May 8, 1999).
GenBank Accession No.: AB037802 (Mar. 14, 2000).
GenBank Accession No.: AB051526 (Feb. 7, 2001).
GenBank Accession No.: AE003628 (Oct. 4, 2000).
GenBank Accession No.: AE004556 (Aug. 30, 2000).
GenBank Accession No.: AF016310 (Dec. 30, 1998).
GenBank Accession No.: AF023130 (Oct. 6, 1999).
GenBank Accession No.: AF064200 (Dec. 11, 1998).
GenBank Accession No.: AF123591 (Apr. 6, 1999).
GenBank Accession No.: AF153906 (Feb. 8, 2000).
GenBank Accession No.: AF186094 (Oct. 16, 1999).
GenBank Accession No.: AF202076 (Nov. 16, 2000).
GenBank Accession No.: AF230378 (Nov. 1, 2001).
GenBank Accession No.: AF230928 (May 9, 2000).
GenBank Accession No.: AF250961 (Nov. 23, 2000).
GenBank Accession No.: AF250963 (Nov. 23, 2000).
GenBank Accession No.: AF251442 (Jan. 2, 2001).
GenBank Accession No.: AF311284 (Sep. 29, 2001).
GenBank Accession No.: AF334755 (Jun. 28, 2001).

GenBank Accession No.: AF399612 (Aug. 27, 2001).
GenBank Accession No.: AJ132998 (Jun. 7, 1999).
GenBank Accession No.: AJ414378 (Oct. 4, 2001).
GenBank Accession No.: AK001748 (Feb. 22, 2000).
GenBank Accession No.: AK056531 (Oct. 31, 2001).
GenBank Accession No.: AX041035 (Nov. 23, 2000).
GenBank Accession No.: AY029413 (Dec. 31, 2001).
GenBank Accession No.: BAA11942 (Feb. 6, 1999).
GenBank Accession No.: BAA20762 (Oct. 6, 2001).
GenBank Accession No.: BAA25487 (Apr. 10, 1998).
GenBank Accession No.: BAA76817 (Jun. 16, 1999).
GenBank Accession No.: BAA88686 (Jan. 7, 2000).
GenBank Accession No.: BAA91879 (Feb. 22, 2000).
GenBank Accession No.: BAA92619 (Mar. 14, 2000).
GenBank Accession No.: BAB21830 (Feb. 7, 2001).
GenBank Accession No.: BAB71206 (Oct. 31, 2001).
GenBank Accession No.: BC003851 (Jul. 12, 2001).
GenBank Accession No.: BC011497 (Aug. 2, 2001).
GenBank Accession No.: BC017476 (Nov. 21, 2001).
GenBank Accession No.: CAB44445 (Jun. 7, 1999).
GenBank Accession No.: CAB44446 (Jun. 7, 1999).
GenBank Accession No.: CAB58578 (Oct. 19, 1999).
GenBank Accession No.: CAC88860 (Oct. 4, 2001).
GenBank Accession No.: D83528 (Sep. 15, 2000).
GenBank Accession No.: D84655 (Feb. 6, 1999).
GenBank Accession No.: J05428 (Aug. 3, 1993).
GenBank Accession No.: JN0619 (Jun. 2, 2000).
GenBank Accession No.: K01930 (Apr. 27, 1993).
GenBank Accession No.: L41351 (Jun. 15, 1995).
GenBank Accession No.: L42229 (Jul. 17, 1995).
GenBank Accession No.: M77092 (Sep. 6, 1995).
GenBank Accession No.: NC_003070 (Jan. 10, 2002). First Pag Only.
GenBank Accession No.: NC_003076 (Jan. 10, 2002). First Page Only.
GenBank Accession No.: NM_001074 (Oct. 31, 2000).
GenBank Accession No.: NM_002338 (Oct. 31, 2000).
GenBank Accession No.: NM_002446 (Oct. 31, 2000).
GenBank Accession No.: NM_002773 (Oct. 31, 2000).
GenBank Accession No.: NM_004619 (Nov. 23, 2000).
GenBank Accession No.: NM_004620 (Dec. 10, 2001).
GenBank Accession No.: NM_006179 (Sep. 21, 2001).
GenBank Accession No.: NM_007865 (Jan. 7, 2002).
GenBank Accession No.: NM_008049 (Jan. 7, 2002).
GenBank Accession No.: NM_008641 (Jan. 7, 2002).
GenBank Accession No.: NM_009424 (Jan. 7, 2002).
GenBank Accession No.: NM_011245 (Jan. 7, 2002).
GenBank Accession No.: NM_011633 (Jan. 7, 2002).
GenBank Accession No.: NM_011857 (Jan. 7, 2002).
GenBank Accession No.: NM_012275 (Nov. 2, 2000).
GenBank Accession No.: NM_013483 (Jan. 7, 2002).
GenBank Accession No.: NM_013581 (Jan. 7, 2002).
GenBank Accession No.: NM_013660 (Jan. 7, 2002).
GenBank Accession No.: NM_013848 (Jan. 7, 2002).
GenBank Accession No.: NM_017789 (Jan. 19, 2002).
GenBank Accession No.: NM_018104 (Dec. 10, 2001).
GenBank Accession No.: NM_019451 (Jan. 7, 2002).
GenBank Accession No.: NM_021682 (Nov. 1, 2000).
GenBank Accession No.: NM_023932 (Feb. 9, 2002).
GenBank Accession No.: NM_025633 (Jan. 7, 2002).
GenBank Accession No.: NM_032063 (May 16, 2001).
GenBank Accession No.: NM_068283 (Dec. 3, 2001).
GenBank Accession No.: NM_079491 (Dec. 14, 2001).
GenBank Accession No.: NP_001065 (Oct. 31, 2000).
GenBank Accession No.: NP_002329 (Oct. 31, 2000).
GenBank Accession No.: NP_002437 (Oct. 31, 2000).
GenBank Accession No.: NP_002764 (Oct. 31, 2000).
GenBank Accession No.: NP_004610 (Nov. 23, 2000).
GenBank Accession No.: NP_004611 (Dec. 10, 2001).
GenBank Accession No.: NP_006170 (Sep. 21, 2001).
GenBank Accession No.: NP_031891 (Jan. 7, 2002).
GenBank Accession No.: NP_032075 (Jan. 7, 2002).
GenBank Accession No.: NP_032667 (Jan. 7, 2002).
GenBank Accession No.: NP_033450 (Jan. 7, 2002).
GenBank Accession No.: NP_035375 (Jan. 7, 2002).
GenBank Accession No.: NP_035763 (Jan. 7, 2002).
GenBank Accession No.: NP_035987 (Jan. 7, 2002).
GenBank Accession No.: NP_036407 (Nov. 2, 2000).
GenBank Accession No.: NP_038511 (Jan. 7, 2002).
GenBank Accession No.: NP_038609 (Jan. 7, 2002).
GenBank Accession No.: NP_038688 (Jan. 7, 2002).
GenBank Accession No.: NP_038876 (Jan. 7, 2002).
GenBank Accession No.: NP_060259 (Jan. 19, 2002).
GenBank Accession No.: NP_060574 (Dec. 10, 2001).
GenBank Accession No.: NP_062324 (Jan. 7, 2002).
GenBank Accession No.: NP_067714 (Nov. 1, 2000).
GenBank Accession No.: NP_076421 (Feb. 9, 2002).
GenBank Accession No.: NP_079909 (Jan. 7, 2002).
GenBank Accession No.: NP_114452 (May 16, 2001).
GenBank Accession No.: NP_172785 (Jan. 10, 2002).
GenBank Accession No.: NP_197134 (Jan. 10, 2002).
GenBank Accession No.: NP_500684 (Dec. 3, 2001).
GenBank Accession No.: NP_524215 (Dec. 14, 2001).
GenBank Accession No.: O46415 (Jul. 15, 1999).
GenBank Accession No.: P02791 (Oct. 16, 2001).
GenBank Accession No.: P06133 (Oct. 16, 2001).
GenBank Accession No.: P16662 (Oct. 16, 2001).
GenBank Accession No.: P34132 (Jun. 1, 1994).
GenBank Accession No.: P34133 (May 30, 2000).
GenBank Accession No.: P34134 (May 30, 2000).
GenBank Accession No.: P41366 (Oct. 16, 2001).
GenBank Accession No.: P80192 (Oct. 16, 2001).
GenBank Accession No.: Q02779 (Oct. 16, 2001).
GenBank Accession No.: Q13972 (Oct. 16, 2001).
GenBank Accession No.: Q16651 (Mar. 1, 2002).
GenBank Accession No.: Q62813 (May 30, 2000).
GenBank Accession No.: Q64151 (Mar. 1, 2002).
GenBank Accession No.: Q9ES87 (Mar. 1, 2002).
GenBank Accession No.: Q9ESD1 (Mar. 1, 2002).
SWALL (SPTR) Accession No.: Q9JLN5 (Oct. 1, 2000).
GenBank Accession No.: Q9Z0J8 (Oct. 16, 2001).
GenBank Accession No.: S41522 (Mar. 8, 2002).
GenBank Accession No.: S71821 (May 7, 1993).
GenBank Accession No.: T42726 (Aug. 18, 2000).
GenBank Accession No.: T50629 (Jul. 21, 2000).
GenBank Accession No.: U02313 (Feb. 25, 1998).
GenBank Accession No.: U69108 (May 31, 1997).
Zippel, et al. (2000). “Calcium and calmodulin are essential for Ras–GRF1–mediated activation of the Ras pathway by lysophosphatidic acid.” *Exp Cell Res* 258(2): 403–8.
GenBank Accession No.: X07830 (Sep. 12, 1993).
GenBank Accession No.: X94744 (Jul. 25, 1996).
GenBank Accession No.: XM_002035 (Feb. 6, 2002).
GenBank Accession No.: XM_027237 (Feb. 7, 2002).
GenBank Accession No.: XM_040307 (Feb. 7, 2002).
GenBank Accession No.: XM_040913 (Feb. 7, 2002).
GenBank Accession No.: XM_045292 (Feb. 6, 2002).
GenBank Accession No.: XM_058875 (Feb. 7, 2002).

GenBank Accession No.: XM_060308 (Feb. 6, 2002).
GenBank Accession No.: XM_060314 (Feb. 6, 2002).
GenBank Accession No.: XM_060315 (Feb. 6, 2002).
GenBank Accession No.: XM_061503 (Feb. 7, 2002).
GenBank Accession No.: XM_061504 (Feb. 7, 2002).
GenBank Accession No.: XM_064951 (Dec. 10, 2001).
GenBank Accession No.: XP_002035 (Feb. 6, 2002).
GenBank Accession No.: XP_027237 (Feb. 7, 2002).
GenBank Accession No.: XP_040307 (Feb. 7, 2002).
GenBank Accession No.: XP_040913 (Feb. 7, 2002).
GenBank Accession No.: XP_045292 (Feb. 6, 2002).
GenBank Accession No.: XP_058875 (Feb. 7, 2002).
GenBank Accession No.: XP_060309 (Feb. 6, 2002).
GenBank Accession No.: XP_060314 (Feb. 6, 2002).
GenBank Accession No.: XP_060315 (Feb. 6, 2002).
GenBank Accession No.: XP_061503 (Feb. 7, 2002).
GenBank Accession No.: XP_061504 (Feb. 7, 2002).
GenBank Accession No.: XP_064951 (Dec. 10, 2001).
GenBank Accession No.: Z48615 (Aug. 30, 1995).

Giglione, et al. (2000). "Identification of eukaryotic peptide deformylases reveals universality of N–terminal protein processing mechanisms." *Embo J* 19(21): 5916–29.

Gilbert (1985). "Genes–in–pieces revisited." *Science* 228(4701): 823–4.

Goldstein and Brown (1973). "Familial hypercholesterolemia: identification of a defect in the regulation of 3–hydroxy–3–methylglutaryl coenzyme A reductase activity associated with overproduction of cholesterol." *Proc Natl Acad Sci U S A* 70(10): 2804–8.

Goldstein, et al. (1977). "Genetics of the LDL receptor: evidence that the mutations affecting binding and internalization are allelic." *Cell* 12(3): 629–41.

Graadt van Roggen, et al. (1991). "Low density lipoprotein receptor founder mutations in Afrikaner familial hypercholesterolaemic patients: a comparison of two geographical areas." *Hum Genet* 88(2): 204–8.

Greenwald, et al. (1975). "Composition of cartilage from lysozyme–deficient rabbits." *Biochim Biophys Acta* 358(2): 435–7.

Griffith, et al. (1998). "Molecular recognition of angiogenesis inhibitors fumagillin and ovalicin by methionine aminopeptidase 2." *Proc Natl Acad Sci U S A* 95(26): 15183–8.

Hallsworth, et al. (2001). "Inhibitors of mitogen–activated protein kinases differentially regulate eosinophil–activating cytokine release from human airway smooth muscle." *Am J Respir Crit Care Med* 164(4): 688–97.

Han, et al. (2001). "c–Jun N–terminal kinase is required for metalloproteinase expression and joint destruction in inflammatory arthritis." *J Clin Invest* 108(1): 73–81.

Hanks and Hunter (1995). "Protein kinases 6. The eukaryotic protein kinase superfamily: kinase (catalytic) domain structure and classification." *Faseb J* 9(8): 576–96.

Harders–Spengel, et al. (1982). "Difference in saturable binding of low density lipoprotein to liver membranes from normocholesterolemic subjects and patients with heterozygous familial hypercholesterolemia." *Proc Natl Acad Sci U S A* 79(20): 6355–9.

Hashimoto, et al. (2001). "IL–4 and IL–13 induce myofibroblastic phenotype of human lung fibroblasts through c–Jun NH2–terminal kinase–dependent pathway." *J Allergy Clin Immunol* 107(6): 1001–8.

Hentze, et al. (1986). "Cloning, characterization, expression, and chromosomal localization of a human ferritin heavy–chain gene." *Proc Natl Acad Sci U S A* 83(19): 7226–30.

Hirai, et al. (1998). "Differential activation of two JNK activators, MKK7 and SEK1, by MKN28– derived nonreceptor serine/threonine kinase/mixed lineage kinase 2." *J Biol Chem* 273(13): 7406–12.

Hobbs, et al. (1990). "The LDL receptor locus in familial hypercholesterolemia: mutational analysis of a membrane protein." *Annu Rev Genet* 24: 133–70.

Hobbs, et al. (1988). "Multiple crm– mutations in familial hypercholesterolemia. Evidence for 13 alleles, including four deletions." *J Clin Invest* 81(3): 909–17.

Hobbs, et al. (1986). "Deletion of exon encoding cystein–rich repeat of low density lipoprotein receptor alters its binding specificity in a subject with familial hypercholesterolemia." *J Biol Chem* 261(28): 13114–20.

Hobbs, et al. (1987). "Deletion in the gene for the low–density–lipoprotein receptor in a majority of French Canadians with familial hypercholesterolemia." *N Engl J Med* 317(12): 734–7.

Hobbs, et al. (1992). "Molecular genetics of the LDL receptor gene in familial hypercholesterolemia." *Hum Mutat* 1(6): 445–66.

Hofmann, et al. (1988). "Overexpression of low density lipoprotein (LDL) receptor eliminates LDL from plasma in transgenic mice." *Science* 239(4845): 1277–81.

Hornick, et al. (1983). "Secretion of lipoproteins from the liver of normal and Watanabe heritable hyperlipidemic rabbits." *Proc Natl Acad Sci U S A* 80(19): 6096–100.

Horsthemke, et al. (1987). "Unequal crossing–over between two alu–repetitive DNA sequences in the low–density–lipoprotein–receptor gene. A possible mechanism for the defect in a patient with familial hypercholesterolaemia." *Eur J Biochem* 164(1): 77–81.

Houlston, et al. (1988). "Lipoprotein (a) and coronary heart disease in familial hypercholesterolaemia." *Lancet* 2(8607): 405.

Hsu, et al. (1997). "ATAR, a novel tumor necrosis factor receptor family member, signals through TRAF2 and TRAF5." *J Biol Chem* 272(21): 13471–4.

Hummel, et al. (1990). "Familial hypercholesterolemia in a rhesus monkey pedigree: molecular basis of low density lipoprotein receptor deficiency." *Proc Natl Acad Sci U S A* 87(8): 3122–6.

Humphries, et al. (1985). "A common DNA polymorphism of the low–density lipoprotein (LDL) receptor gene and its use in diagnosis." *Lancet* 1(8436): 1003–5.

Ip, et al. (1992). "Mammalian neurotrophin–4: structure, chromosomal localization, tissue distribution, and receptor specificity." *Proc Natl Acad Sci U S A* 89(7): 3060–4.

Ishibashi, et al. (1994). "Massive xanthomatosis and atherosclerosis in cholesterol–fed low density lipoprotein receptor–negative mice." *J Clin Invest* 93(5): 1885–93.

Ishibashi, et al. (1993). "Hypercholesterolemia in low density lipoprotein receptor knockout mice and its reversal by adenovirus–mediated gene delivery." *J Clin Invest* 92(2): 883–93.

Jackson, et al. (1987). "Cloning of a human liver microsomal UDP–glucuronosyltransferase cDNA." *Biochem J* 242(2): 581–8.

Jensen, et al. (1999). "Linking genotype to aorto–coronary atherosclerosis: a model using familial hypercholesterolemia and aorto–coronary calcification." *Ann Hum Genet* 63(Pt 6): 511–20.

Jin, et al. (1993). "cDNA cloning and expression of two new members of the human liver UDP–glucuronosyltransferase 2B subfamily." *Biochem Biophys Res Commun* 194(1): 496–503.

Katoh, et al. (1995). "Cloning and characterization of MST, a novel (putative) serine/threonine kinase with SH3 domain." *Oncogene* 10(7): 1447–51.

Kingsley and Krieger (1984). "Receptor–mediated endocytosis of low density lipoprotein: somatic cell mutants define multiple genes required for expression of surface– receptor activity." *Proc Natl Acad Sci U S A* 81(17): 5454–8.

Kita, et al. (1987). "Probucol prevents the progression of atherosclerosis in Watanabe heritable hyperlipidemic rabbit, and animal model for familial hypercholesterolemia." *Proc Natl Acad Sci U S A* 84(16): 5928–31.

Knoblauch, et al. (2000). "A cholesterol–lowering gene maps to chromosome 13q." *Am J Hum Genet* 66(1): 157–66.

Kotze, et al. (1987). "Haplotype associations of three DNA polymorphisms at the human low density lipoprotein receptor gene locus in familial hypercholesterolaemia." *J Med Genet* 24(12): 750–5.

Krasnewich, et al. (1987). "Localization of UDP glucuronosyltransferase gene(s) on mouse chromosome 5." *Somat Cell Mol Genet* 13(2): 179–82.

Kwiterovich, et al. (1974). "Familial hypercholesterolemia (one form of familial type II hyperlipoproteinemia). A study of its biochemical, genetic and clinical presentation in childhood." *J Clin Invest*53(5): 1237–49.

Lebo, et al. (1985). "Human ferritin light chain gene sequences mapped to several sorted chromosomes." *Hum Genet* 71(4): 325–8.

Lee, et al. (1998). "Identification of a common low density lipoprotein receptor mutation (C163Y) in the west of Scotland." *J Med Genet* 35(7): 573–8.

Lehrman, et al. (1987). "Duplication of seven exons in LDL receptor gene caused by Alu–Alu recombination in a subject with familial hypercholesterolemia." *Cell* 48(5): 827–35.

Leitersdorf, et al. (1989). "Polymorphic DNA haplotypes at the LDL receptor locus." *Am J Hum Genet* 44(3): 409–21.

Leitersdorf, et al. (1990). "Common low–density lipoprotein receptor mutations in the French Canadian population." *J Clin Invest* 85(4): 1014–23.

Leppert, et al. (1986). "A DNA probe for the LDL receptor gene is tightly linked to hypercholesterolemia in a pedigree with early coronary disease." *Am J Hum Genet* 39(3): 300–6.

Levy, et al. (1986). "Diversity in expression of heterozygous familial hypercholesterolemia. Characterization of a unique kindred." *J Clin Invest* 78(1): 96–101.

Li, et al. (1988). "Amplification and analysis of DNA sequences in single human sperm and diploid cells." *Nature* 335(6189): 414–7.

Lindgren, et al. (1985). "Human genes involved in cholesterol metabolism: chromosomal mapping of the loci for the low density lipoprotein receptor and 3–hydroxy–3 methylglutaryl–coenzyme A reductase with cDNA probes." *Proc Natl Acad Sci U S A* 82(24): 8567–71.

Lodge, et al. (2000). "Co–localisation, heterophilic interactions and regulated expression of IgLON family proteins in the chick nervous system." *Brain Res Mol Brain Res* 82(1–2): 84–94.

Lumeng, et al. (1999). "Interactions between beta 2–syntrophin and a family of microtubule–associated serine/threonine kinases," *Nat Neurosci* 2(7):611–7.

Ma, et al. (1989). "Identification of a second "French Canadian" LDL receptor gene deletion and development of a rapid method to detect both deletions." *Clin Genet* 36(4):219–28.

Marg, et al. (1999). "Neurotractin, a novel neurite outgrowth–promoting Ig–like protein that interacts with CEPU–1 and LAMP." *J. Cell Biol* 145(4):865–76.

McGill, et al. (1984). "Localization of the haptoglobin alpha and beta genes (HPA and HPB) to human chromosome 16q22 by in situ hybridization." *Cytogenet Cell Genet* 38(2): 155–7.

Mieda, et al. (1999). "Compartmentalized expression of zebrafish ten–m3 and ten–m4, homologues of the *Drosophila* ten(m)/odd Oz gene, in the central nervous system." *Mech Dev* 87(1–2):223–7.

Miller, et al. (1990). "Cloning and characterization of a second complementary DNA for human tryptase." *J Clin Invest* 86(3):864–70.

Miyake, et al. (1981). "Homozygous familial hypercholesterolemia mutant with a defect in internalization of low density lipoprotein." *Proc Natl Acad Sci U S A* 78(8):5151–5.

Miyata, et al. (2000). "Expression of the IgLON cell adhesion molecules Kilon and OBCAM in hypothalamic magnocellular neurons." *J Comp Neurol* 424(1):74–85.

Mizushima, et al. (1998). "Cloning and characterization of a cDNA encoding the human homolog of tumor necrosis factor receptor–associated factor 5 (TRAF5)." *Gene* 207(2):135–40.

Monaghan, et al. (1994). "Isolation of a human YAC contig encompassing a cluster of UGT2 genes and its regional localization to chromosome 4q13." *Genomics* 23(2):496–9.

Monaghan, et al. (1992). "Localization of a bile acid UDP–glucuronosyltransferase gene (UGT2B) to chromosome 4 using the polymerase chain reaction." *Genomics* 13(3):908–9.

Mulero, et al. (1999). "IL1HY1: A novel interleukin–1 receptor antagonist gene." *Biochem Biophys Res Commun* 263(3):702–6.

Nakano, et al. (1996). "TRAF5, an activator of NF–kappaB and putative signal tranducer for the lymphotoxin–beta receptor." *J Biol Chem* 271(25): 14661–4.

Nakano, et al. (1997). "Human TNF receptor–associated factor 5 (TRAF5):cDNA cloning, expression and assignment of the TRAF5 gene to chromosome 1q32." *Genomics* 42(1): 26–32.

Ott, et al. (1974). "Linkage studies in a large kindred with familial hypercholesterolemia." *Am J Hum Genet* 26(5):598–603.

Overbeck, et al. (1995). "Guanine nucleotide exchange factors: activators of Ras superfamily proteins." *Mol Reprod Dev* 42(4):468–76.

Prieur, et al. (1974). "Lysozyme deficiency–an inherited disorder of rabbits." *Am J Pathol* 77(2):283–98.

Puschel, et al. (1995). "Murine semaphorin D/collapsin is a member of a diverse gene family and creates domains inhibitory for axonal extension." *Neuron* 14(5):941–8.

Rawlings and Barrett (1994). "Families of serine peptidases." *Methods Enzymol* 244: 19–61.

Rudiger, et al. (1991). "Repetitive sequences involved in the recombination leading to deletion of exon 5 of the low–density–lipoprotein receptor gene in a patient with familial hypercholesterolemia." *Eur J Biochem* 198(1): 107–11.

Ruffner, et al. (1987). "Invasion of the human albumin–alpha–fetoprotein gene family by Alu, Kpn, and two novel repetitive DNA elements." *Mol Biol Evol* 4(1): 1–9.

Russell, et al. (1984). "Domain map of the LDL receptor: sequence homology with the epidermal growth factor precursor." *Cell* 37(2):577–85.

Santoro, et al. (1986), "Cloning of the gene coding for human L apoferritin." *Nucleic Acids Res* 14(7):2863–76.

Sass, et al. (1995). "Evidence for a cholesterol–lowering gene in a French–Canadian kindred with familial hypercholesterolemia." *Hum Genet* 96(1):21–6.

Scanu, et al. (1988). "Genetically determined hypercholesterolemia in a rhesus monkey family due to a deficiency of the LDL receptor." *J Lipid Res* 29(12):1671–81.

Schuster, et al. (1995). "Identification of the valine 408 to methionine mutation in the LDL receptor in a Greek patient with homozygous familial hypercholesterolemia." *Clin Genet* 48(2):90–2.

Seftel, et al. (1980). "A host of hypercholesterolaemic homozygotes in South Africa." *Br Med J* 281(6241): 633–6.

Sin, et al. (1997). "The anti–angiogenic agent fumagillin covalently binds and inhibits the methionine aminopeptidase, MetAP–2," *Proc Natl Acad Sci U S A* 94(12): 6099–103.

Slagel, et al. (1987). "Clustering and subfamily relationships of the Alu family in the human genome." *Mol Biol Evol* 4(1): 19–29.

Starzl, et al. (1984). "Heart–liver transplantation in a patient with familial hypercholesterolaemia." *Lancet* 1(8391): 1382–3.

Steyn, et al. (1989) "The use of low density lipoprotein receptor activity of lymphocytes to determine the prevalence of familial hypercholesterolaemia in a rural South African community." *J Med Genet* 26(1):32–6.

Sudhof, et al. (1985). "The LDL receptor gene: a mosaic of exons shared with different proteins." *Science* 228(4701): 815–22.

Summers, et al. (1998). "Evaluation of the aortic root by MRI: insights from patients with homozygous familial hypercholesterolemia." *Circulation* 98(6): 509–18.

SWALL (SPTR) Accession No.: O00463 (Jul. 1, 1997).

SWALL (SPTR) Accession No.: Q60592 (Nov. 1, 1996).

SWALL (SPTR) Accession No.: Q9CPW9 (Jun. 1, 2001).

SWALL (SPTR) Accession No.: Q9QYP3 (May 1, 2000).

SWALL (SPTR) Accession No.: Q9UBH0 (May 1, 2000).

SWALL (SPTR) Accession No.: Q9WTS7 (Nov. 1, 1999).

SWALL (SPTR) Accession No.: Q9Y4K3 (Nov. 1, 1999).

SWALL (SPTR) Accession No.: Q9Z160 (May 1, 1999).

Takayanagi, et al. (2000). "T–cell–mediated regulation of osteoclastogenesis by signalling cross–talk between RANKL and IFN–gamma." *Nature* 408(6812): 600–5.

Taniyama, et al. (1991). "Evidence for intramolecular disulfide bond shuffling in the folding of mutant human lysozyme." *J Biol Chem* 266(10): 6456–61.

Tolleshaug, et al. (1982). "Posttranslational processing of the LDL receptor and its genetic disruption in familial hypercholesterolemia." *Cell* 30(3): 715–24.

Tonstad, et al. (1996). "Efficacy and safety of cholestyramine therapy in peripubertal and prepubertal children with familial hypercholesterolemia." *J Pediatr* 129(1): 42–9.

Top, et al. (1992). "Absence of mutations in the promoter region of the low density lipoprotein receptor gene in a large number of familial hypercholesterolaemia patients as revealed by denaturing gradient gel electrophoresis." *Hum Genet* 89(5): 561–5.

Torrington and Botha (1981). "Familial hypercholesterolaemia and church affiliation." *Lancet* 2(8255): 1120.

Ullu and Tschudi (1984). "Alu sequences are processed 7SL RNA genes." *Nature* 312(5990):171–2.

Uyeda, et al. (1994). "Cloning and sequencing of hen magnum cDNAs encoding vitelline membrane outer layer protein I (VMO–I)." *Gene* 144(2): 311–2.

Vanderslice, et al. (1990). "Human mast cell tryptase: multiple cDNAs and genes reveal a multigene serine protease family." *Proc Natl Acad Sci U S A* 87(10): 3811–5.

Varret, et al. (1997). "Software and database for the analysis of mutations in the human LDL receptor gene." *Nucleic Acids Res* 25(1): 172–80.

Vaughan, et al. (2000). "A t(2;19)(p13;p13.2) in a giant invasive cardiac lipoma from a patient with multiple lipomatosis." *Gene Chromosomes Cancer* 28(2): 133–7.

Vergopoulos, et al. (1997). "A xanthomatosis–susceptibility gene may exist in a Syrian family with familial hypercholesterolemia." *Eur J Hum Genet* 5(5): 315–23.

Walden and Millette (1996). "Increased activity associated with the MAST205 protein kinase complex during mammalian spermiogenesis." *Biol Reprod* 55(5): 1039–44.

Walden and Cowan (1993). "A novel 205–kilodalton testis–specific serine/threonine protein kinase associated with microtubules of the spermatid manchette." *Mol Cell Biol* 13(12): 7625–35.

Watanabe and Drysdale (1981). "Evidence for distinct mRNAs for ferritin subunits." *Biochem Biophys Res Commun* 98(2): 507–11.

Wilson, et al. (1998). "A World Wide Web site for low–density lipoprotein receptor gene mutations in familial hypercholesterolemia: sequence–based, tabular, and direct submission data handling." *Am J Cardiol* 81(12): 1509–11.

Wilson, et al. (1992). "Ex vivo gene therapy of familial hypercholesterolemia." *Hum Gene Ther* 3(2): 179–222.

Wong, et al. (1999). "TRANCE, a TNF family member, activates Akt/PKB through a signaling complex involving TRAF6 and c–Src." *Mol Cell* 4(6):1041–9.

Wootton and Federhen (1996). "Analysis of compositionally biased regions in sequence databases." *Methods Enzymol* 266: 554–71.

Worwood, et al. (1985). "Assignment of human ferritin genes to chromosomes 11 and 19q13.3—19qter." *Hum Genet* 69(4): 371–4.

Xu, et al. (2001). "The MLK family mediates c–Jun N–terminal kinase activation in neuronal apoptosis." *Mol Cell Biol* 21(14): 4713–24.

Yamakawa, et al. (1989). "Three novel partial deletions of the low–density lipoprotein (LDL) receptor gene in familial hypercholesterolemia." *Hum Genet* 82(4):317–21.

Yamakawa, et al. (1988). "Taql polymorphism in the LDL receptor gene and a Taql 1.5–kb band associated with familial hypercholesterolemia." *Hum Genet* 80(1):1–5.

Yamamoto, et al. (1986). "Deletion in cysteine–rich region of LDL receptor impedes transport to cell surface in WHHL rabbit." *Science* 232(4755): 1230–7.

Ye, et al. (2000). "Ermap, a gene coding for a novel erythroid specific adhesion/receptor membrane protein." *Gene* 242(1–2):337–45.

Yoshimura, et al. (1988). "Human lysozyme: sequencing of a cDNA, and expression and secretion by *Saccharomyces cerevisiae.*" *Biochem Biophys Res Commun* 150(2): 794–801.

Yu, et al. (1995). "Molecular cloning, tissue–specific expression, and cellular localization of human prostasin mRNA." *J Biol Chem* 270(22): 13483–9.

* cited by examiner

NUCLEIC ACID ENCODING A NOVX13 POLYPEPTIDE

RELATED APPLICATIONS

This application claims priority to U.S. Ser. No. 60/260,417, filed Jan. 9, 2001; U.S. Ser. No. 60/260,831, filed Jan. 10, 2001; U.S. Ser. No. 60/272,338, filed Feb. 28, 2001; U.S. Ser. No. 60/274,876, filed Mar. 9, 2001, and U.S. Ser. No. 60/284,704, filed Apr. 18, 2001 each of which is incorporated by reference in its entirety.

FIELD OF THE INVENTION

The invention relates to polynucleotides and the polypeptides encoded by such polynucleotides, as well as vectors, host cells, antibodies and recombinant methods for producing the polypeptides and polynucleotides, as well as methods for using the same.

BACKGROUND OF THE INVENTION

The present invention is based in part on nucleic acids encoding proteins that are new members of the following protein families: TEN-M4-like, Semphorin-like, Erythroid membrane associated-like, Vitelline membrane outer layer I precursor-like, MAST205-like, Kilon-like, Mixed lineage kinase 2-like, S-1 like, Guanine Nucleotide Releasing-like, Interleukin-1 like, Interleukin-1 signal transducer-like, GPCR-like, Glucuronosyl transferase-like, Prostasin-like, LDLR-like, TNFR-like, TRAF5-like, Ferritin light chain-like, Neurotrophin-6 alpha-like and Methionyl Aminopeptidase-like. More particularly, the invention relates to nucleic acids encoding novel polypeptides, as well as vectors, host cells, antibodies, and recombinant methods for producing these nucleic acids and polypeptides.

SUMMARY OF THE INVENTION

The invention is based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, NOV8, NOV9, NOV10, NOV 11, NOV12, NOV13, NOV14, NOV15, NOV16, NOV17, NOV18 and NOV19 nucleic acids and polypeptides. These nucleic acids and polypeptides, as well as derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:1, 3, 5, 7, 9, 11, 13, 15, 17, 19, 21, 23, 25, 27, 29, 31, 33, 34, 35, 37, 39, 41, 43, 45, 47 and 49. In some embodiments, the NOVX nucleic acid molecule will hybridize under stringent conditions to a nucleic acid sequence complementary to a nucleic acid molecule that includes a protein-coding sequence of a NOVX nucleic acid sequence. The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:2, 4, 6, 8, 10, 12, 14, 16, 18, 20, 22, 24, 26, 28, 30, 32, 36, 38, 40, 42, 44, 46, 48 and 50. The nucleic acid can be, for example, a genomic DNA fragment or a cDNA molecule that includes the nucleic acid sequence of any of SEQ ID NOS:1, 3, 5, 7, 9, 11, 13, 15, 17, 19, 21, 23, 25, 27, 29, 31, 33, 34, 35, 37, 39, 41, 43, 45, 47 and 49.

Also included in the invention is an oligonucleotide, e.g., an oligonucleotide which includes at least 6 contiguous nucleotides of a NOVX nucleic acid (e.g., SEQ ID NOS:1, 3, 5, 7, 9, 11, 13, 15, 17, 19, 21, 23, 25, 27, 29, 31, 33, 34, 35, 37, 39, 41, 43, 45, 47 and 49) or a complement of said oligonucleotide. Also included in the invention are substantially purified NOVX polypeptides (SEQ ID NOS:2, 4, 6, 8, 10, 12, 14, 16, 18, 20, 22, 24, 26, 28, 30, 32, 36, 38, 40, 42, 44, 46, 48 and 50). In certain embodiments, the NOVX polypeptides include an amino acid sequence that is substantially identical to the amino acid sequence of a human NOVX polypeptide.

The invention also features antibodies that immunoselectively bind to NOVX polypeptides, or fragments, homologs, analogs or derivatives thereof.

In another aspect, the invention includes pharmaceutical compositions that include therapeutically- or prophylactically-effective amounts of a therapeutic and a pharmaceutically-acceptable carrier. The therapeutic can be, e.g., a NOVX nucleic acid, a NOVX polypeptide, or an antibody specific for a NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a NOVX nucleic acid, under conditions allowing for expression of the NOVX polypeptide encoded by the DNA. If desired, the NOVX polypeptide can then be recovered.

In another aspect, the invention includes a method of detecting the presence of a NOVX polypeptide in a sample. In the method, a sample is contacted with a compound that selectively binds to the polypeptide under conditions allowing for formation of a complex between the polypeptide and the compound. The complex is detected, if present, thereby identifying the NOVX polypeptide within the sample.

The invention also includes methods to identify specific cell or tissue types based on their expression of a NOVX.

Also included in the invention is a method of detecting the presence of a NOVX nucleic acid molecule in a sample by contacting the sample with a NOVX nucleic acid probe or primer, and detecting whether the nucleic acid probe or primer bound to a NOVX nucleic acid molecule in the sample.

In a further aspect, the invention provides a method for modulating the activity of a NOVX polypeptide by contacting a cell sample that includes the NOVX polypeptide with a compound that binds to the NOVX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

Also within the scope of the invention is the use of a therapeutic in the manufacture of a medicament for treating or preventing disorders or syndromes including, e.g., trauma, regeneration (in vitro and in vivo), viral/bacterial/parasitic infections, Von Hippel-Lindau (VHL) syndrome, Alzheimer's disease, stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, behavioral disorders, addiction, anxiety, pain, actinic keratosis, acne, hair growth diseases, allopecia, pigmentation disorders, endocrine disorders, connective tissue disorders, such as severe neonatal Marfan syndrome, dominant ectopia lentis, familial ascending aortic aneurysm, isolated skeletal features of Marfan syndrome, Shprintzen-Goldberg syndrome, genodermatoses, contractural arachnodactyly, inflammatory disorders such as osteo- and rheumatoid-arthritis, inflammatory bowel disease, Crohn's disease; immunological disorders, AIDS; cancers including but not limited to lung cancer, colon cancer, Neoplasm; adenocarcinoma; lymphoma; prostate cancer; uterus cancer, leukemia or pancreatic cancer; blood disorders; asthma; psoriasis; vascular disorders, hypertension, skin disorders, renal disorders including Alport syndrome, immunological disorders, tissue injury, fibrosis disorders, bone diseases, Ehlers-Danlos syndrome type VI, VII, type IV, S-linked cutis laxa and Ehlers-Danlos syndrome type V, osteogenesis imperfecta, Neurologic diseases, Brain and/or autoimmune disorders like encephalomyelitis, neurodegenerative disorders, immune disorders, hematopoietic disorders, muscle disorders, inflammation and wound repair, bacterial, fungal, protozoal and viral infections (particularly infections caused by HIV-1 or HIV-2), pain, acute heart failure, hypotension, hypertension, urinary retention, osteoporosis, Treatment of Albright Hereditary Ostoeodystrophy, angina pectoris, myocardial infarction, ulcers, benign prostatic hypertrophy, arthrogryposis multiplex congenita, osteogenesis imperfecta, keratoconus, scoliosis, duodenal atresia, esophageal atresia, intestinal malrotation, Pancreatitis, Obesity Systemic lupus erythematosus, Autoimmune disease, Emphysema, Scleroderma, allergy, ARDS, Neuroprotection, Fertility Myasthenia gravis, Diabetes, obesity, Growth and reproductive disorders Hemophilia, Hypercoagulation, Idiopathic thrombocytopenic purpura, Immunodeficiencies, Graft vesus host, Adrenoleukodystrophy, Congenital Adrenal Hyperplasia, Endometriosis, Xerostomia, Ulcers, Cirrhosis, Transplantation, Diverticular disease, Hirschsprung's disease, Appendicitis, Arthritis, Ankylosing spondylitis, Tendinitis, Renal artery stenosis, Interstitial nephritis, Glomerulonephritis, Polycystic kidney disease, erythematosus, Renal tubular acidosis, IgA nephropathy, anorexia, bulimia, psychotic disorders, including anxiety, schizophrenia, manic depression, delirium, dementia, severe mental retardation and dyskinesias, such as Huntington's disease and/or other pathologies and disorders of the like.

The therapeutic can be, e.g., a NOVX nucleic acid, a NOVX polypeptide, or a NOVX-specific antibody, or biologically-active derivatives or fragments thereof.

For example, the compositions of the present invention will have efficacy for treatment of patients suffering from the diseases and disorders disclosed above and/or other pathologies and disorders of the like. The polypeptides can be used as immunogens to produce antibodies specific for the invention, and as vaccines. They can also be used to screen for potential agonist and antagonist compounds. For example, a cDNA encoding NOVX may be useful in gene therapy, and NOVX may be useful when administered to a subject in need thereof. By way of non-limiting example, the compositions of the present invention will have efficacy for treatment of patients suffering from the diseases and disorders disclosed above and/or other pathologies and disorders of the like.

The invention further includes a method for screening for a modulator of disorders or syndromes including, e.g., the diseases and disorders disclosed above and/or other pathologies and disorders of the like. The method includes contacting a test compound with a NOVX polypeptide and determining if the test compound binds to said NOVX polypeptide. Binding of the test compound to the NOVX polypeptide indicates the test compound is a modulator of activity, or of latency or predisposition to the aforementioned disorders or syndromes.

Also within the scope of the invention is a method for screening for a modulator of activity, or of latency or predisposition to disorders or syndromes including, e.g. the diseases and disorders disclosed above and/or other pathologies and disorders of the like by administering a test compound to a test animal at increased risk for the aforementioned disorders or syndromes. The test animal expresses a recombinant polypeptide encoded by a NOVX nucleic acid. Expression or activity of NOVX polypeptide is then measured in the test animal, as is expression or activity of the protein in a control animal which recombinantly-expresses NOVX polypeptide and is not at increased risk for the disorder or syndrome. Next, the expression of NOVX polypeptide in both the test animal and the control animal is compared. A change in the activity of NOVX polypeptide in the test animal relative to the control animal indicates the test compound is a modulator of latency of the disorder or syndrome.

In yet another aspect, the invention includes a method for determining the presence of or predisposition to a disease associated with altered levels of a NOVX polypeptide, a NOVX nucleic acid, or both, in a subject (e.g., a human subject). The method includes measuring the amount of the NOVX polypeptide in a test sample from the subject and comparing the amount of the polypeptide in the test sample to the amount of the NOVX polypeptide present in a control sample. An alteration in the level of the NOVX polypeptide in the test sample as compared to the control sample indicates the presence of or predisposition to a disease in the subject. Preferably, the predisposition includes, e.g., the diseases and disorders disclosed above and/or other pathologies and disorders of the like. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a NOVX polypeptide, a NOVX nucleic acid, or a NOVX-specific antibody to a subject (e.g., a human subject), in an amount sufficient to alleviate or prevent the pathological condition. In preferred embodiments, the disorder, includes, e.g., the diseases and disorders disclosed above and/or other pathologies and disorders of the like.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules.

NOVX nucleic acids and polypeptides are further useful in the generation of antibodies that bind immuno-specifically to the novel NOVX substances for use in therapeutic or diagnostic methods. These NOVX antibodies may be generated according to methods known in the art, using prediction from hydrophobicity charts, as described in the "Anti-NOVX Antibodies" section below. The disclosed NOVX proteins have multiple hydrophilic regions, each of which can be used as an immunogen. These NOVX proteins can be used in assay systems for functional analysis of various human disorders, which will help in understanding of pathology of the disease and development of new drug targets for various disorders.

The NOVX nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The present invention provides novel nucleotides and polypeptides encoded thereby. Included in the invention are the novel nucleic acid sequences and their encoded polypeptides. The sequences are collectively referred to herein as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

The NOVX nucleic acids and polypeptides can also be used to screen for molecules, which inhibit or enhance NOVX activity or function. Specifically, the nucleic acids and polypeptides according to the invention may be used as targets for the identification of small molecules that modulate or inhibit, e.g., neurogenesis, cell differentiation, cell proliferation, hematopoiesis, wound healing and angiogenesis.

Additional utilities for the NOVX nucleic acids and polypeptides according to the invention are disclosed herein.

NOV1

A disclosed NOV1 nucleic acid of 8438 nucleotides (also referred to as CG56091-01) encoding a novel TEN-M4-like protein is shown in Table 1A. An open reading frame was identified beginning with an ATG initiation codon at nucleotides 4–6 and ending with a TGA codon at nucleotides 8436–8438. A putative untranslated region upstream from the intiation codon is underlined in Table 1A, and the start and stop codons are in bold letters.

TABLE A

Sequences and Corresponding SEQ ID Numbers

| NOVX Assignment | Internal Identification | SEQ ID NO (nucleic acid) | SEQ ID NO (polypeptide) | Homology |
|---|---|---|---|---|
| 1 | 20422974_0_132_da1 | 1 | 2 | TEN-M4 like |
| 2 | CG56091-01 | 3 | 4 | Semphorin like |
| 3 | CG50351_01 | 5 | 6 | Erythroid membrane associated like |
| 4a | 133268995_da1 | 7 | 8 | Vitelline membrane outer layer I precursor like |
| 4b | CG56375-04 | 9 | 10 | Vitelline membrane outer layer I precursor like |
| 5 | CG56089-01 | 11 | 12 | MAST205 like |
| 6 | CG56087-01 | 13 | 14 | Kilon like |
| 7 | CG56071-01 | 15 | 16 | Mixed lineage kinase 2 like |
| 8 | CG56042-01 | 17 | 18 | S-1 like |
| 9 | CG55997-02 | 19 | 20 | Guanine Nucleotide Releasing like |
| 10 | CG56083-01 | 21 | 22 | Interleukin-1 like |
| 11 | CG56093-01 | 23 | 24 | Interleukin-1 signal transducer-like |
| 12 | CG56138-01 | 25 | 26 | GPCR like |
| 13 | CG56097-01 | 27 | 28 | Glucuronosyl transferase like |
| 14a | CG56123-01 | 29 | 30 | Prostasin like |
| 14b | CG56123-02 | 31 | 32 | Prostasin like |
| — | 162262711 | 33 | — | Prostasin like |
| — | 162262716 | 34 | — | Prostasin like |
| 15 | CG50153-01/ AC025263_da2 | 35 | 36 | LDLR like |
| 16a | CG56108-01 | 37 | 38 | TNFR like |
| 16b | CG56108-02 | 49 | 50 | TRAF5 like |
| 17 | CG56101-01 | 39 | 40 | Ferritin light chain like |
| 18 | CG56095-01 | 41 | 42 | Neurotrophin-6 alpha like |
| 19a | CG50287-02 | 43 | 44 | Methionyl Aminopeptidase like |
| 19b | CG50287-01 | 45 | 46 | Methionyl Aminopeptidase like |
| 19c | CG50287-03 | 47 | 48 | Methionyl Aminopeptidase like |

TABLE 1A

| NOV1 nucleotide sequence. |
| --- |
| (SEQ ID NO:1)<br>GCC**ATG**GACGTGAAGGAGAGGAAGCCTTACCGCTCGCTGACCCGGCGCCGCGACGCCGAGCGCCGCTACACCAGCTCGTCC<br>GCGGACAGCGAGGAGGGCAAAGCCCCGCAGAAATCGTACAGCTCCAGCGAGACCCTGAAGGCCTACGACCAGGACGCCCGC<br>CTAGCCTATGGCAGCCGCGTCAAGGACATTGTGCCGCAGGAGGCCGAGGAATTCTGCCGCACAGGTGCCAACTTCACCCTG<br>CGGGAGCTGGGGCTGGAAGAAGTAACGCCCCCTCACGGGACCCTGTACCGGACAGACATTGGCCTCCCCCACTGCGGCTAC<br>TCCATGGGGGCTGGCTCTGATGCCGACATGGAGGCTGCACACGGTGCTGTCCCCTGAGCACCCCGTGCGTCTGTGGGGCCGG<br>AGCACACGGTCAGGGCGCAGCTCCTGCCTGTCCAGCCGGGCCAATTCCAATCTCACACTCACCGACACCGAGCATGAAAAC<br>ACTGAGACTGATCATCCGGGCGGCCTGCAGAACCACGCGCGGCTCCGGACGCCGCCGCCGCCGCTCTCGCACGCCCACACC<br>CCCAACCAGCACCACGCGGCCTCCATTAACTCCCTGAACCGGGGCAACTTCACGCCGAGGAGCAACCCCAGCCCGGCCCCC<br>ACGGACCACTCGCTCTCCGGAGAGCCCCCTGCCGGCGGCGCCCAGGAGCCTGCCCACGCCCAGGAGAACTGGCTGCTCAAC<br>AGCAACATCCCCCTGGAGACCAGAAACCTAGGCAAGCAGCCATTCCTAGGGACATTGCAGGACAACCTCATTGAGATGGAC<br>ATTCTCGGCGCCTCCCGCCATGATGGGGCTTACAGTGACGGGCACTTCCTCTTCAAGCCTGGAGGCACCTCCCCGCTCTTC<br>TGCACCACATCACCAGGGTACCCACTGACGTCCAGCACAGTGTACTCTCCTCCGCCCCGACCCCTGCCCCGCAGCACCTTC<br>GCCTGGCCGGCCTTTAACCTCAAGAAGCCCTCCAAGTACTGTAACTGGAAGTGCGCAGCCCTGAGCGCCATCGTCATCTCA<br>GCCACTCTGGTCATCCTGCTGGCATACTTTGTGGCCATGCACCTGTTTGGCCTAAACTGGCACCTGCAGCCGATGGAGGGG<br>CAGATGACGGATTTATGAGATCACGGAGGACACAGCCAGCAGTTGGCCTGTGCCAACCGACGTCTCCCTATACCCCTCAGG<br>GGGCACTGGCTTAGAGACCCCTGACAGGAAAGGCAAAGGAACCACAGAAGGAAAGCCCAGTAGTTTCTTTCCAGAGGCCAG<br>TTTCATAGATTCTGGAGAAATTGATGTGGGAAGGCGAGCTTCCCAGAAGATTCCTCCTGGCACTTTCTGGAGATCTCAAGT<br>GTTCATAGACCATCCTGTGCATCTGAAATTCAATGTGTCTCTGGGAAAGGCAGCCCTGGTTGGCATTTATGGCAGAAAAGG<br>CCTCCCTCCTTCACATACACAGTTTGACTTTGTGGAGCTGCTGGATGGCAGGAGGCTCCTAACCCAGGAGGCGCGGAGCCT<br>AGAGGGGACCCCGCGCCAGTCTCGGGGAACTGTGCCCCCCTCCAGCCATGAGACAGGCTTCATCCAGTATTTGGATTCAGG<br>AATCTGGCACTTGGCTTTTTACAATGACGGAAAGGAGTCAGAAGTGGTTTCCTTTCTCACCACTGCCATTCTTGATTCCTG<br>GGCTCTCTGTTTGGGTGATGGAGAATGCGTTTCTGGAACTTGCCATTGTTTTCCAGGATTTCTGGGTCCGGATTGTTCAAG<br>AGCCGCCTGTCCAGTGTTATGTAGTGGCAACGGGCAGTACTCCAAGGGCCGCTGCCTGTGTTTCAGCGGCTGGAAGGGCAC<br>CGAGTGTGATGTGCCGACTACCCAGTGTATTGACCCACAGTGTGGGGGTCGTGGGATTTGTATCATGGGCTCCTGTGCTTG<br>CAACTCAGGATACAAAGGAGAAAGTTGTGAAGAAGCTGACTGTATAGACCCTGGGTGTTCTAATCATGGTGTGTGTATCCA<br>CGGGGAATGTCACTGCAGTCCAGGATGGGGAGGTAGCAATTGTGAAATACTGAAGACCATGTGTCCAGACCAGTGCTCCGG<br>CCACGGAACGTATCTTCAAGAAAGTGGCTCCTGCACGTGTGACCCTAACTGGACTGGCCCAGACTGCTCAAACGAAATATG<br>TTCTGTGGACTGTGGCTCACACGGCGTTTGCATGGGGGGGACGTGTCGCTGTGAAGAAGGCTGGACGGGCCCAGCCTGTAA<br>TCAGAGAGCCTGCCACCCCCGCTGTGCCGAGCACGGGACCTGCCGCGACGGCAAGTGCGAGTGCAGCCCTGGCTGGAATGG<br>CGAACACTGCACCATCTCCCTAGCTCACTATCTGGATAGGGTAGTTAAACTTTCAGAGGGTTGCCCTGGGTTGTGCAATGG<br>CAACGGCAGATGTACCTTAGACCTGAATGGTTGGCACTGCGTCTGCCAGCTGGGCTGGAGAGGAGCTGGCTGTGACACTTC<br>CATCGAGACTGCCTGCGGTGACAGCAAAGACAATGATGGAGATGGCCTGGTGGACTGCATGGACCCTGACTGCTGCCTCCA<br>GCCCCTGTGCCATATCAACCCGCTGTGCCTTGGCTCCCCTAACCCTCTGGACATCATCCAGGAGACACAGGTCCCTGTGTC<br>ACAGCAGAACCTACACTCCTTCTATGACCGCATCAAGTTCCTCGTGGGCAGGGACAGCACGCACATAATCCCCGGGGAGAA<br>CCCCTTTGATGGAGGGCATGCTTGTCTTATTCGTGGCCAAGTGATGACATCAGATGGAACCCCCCTGGTTGGTGTGAACAT<br>CAGTTTTGTCAATAACCCTCTCTTTGGATATACAATCAGCAGGCAAGATGGCAGCTTTGACTTGGTGACAAATGGCGGCAT<br>CTCCATCATCCTGCGGTTCGAGCGGGCACCTTTCATCACACAGGAGCACACCCTGTGGCTGCCATGGGATCGCTTCTTTGT<br>CATGGAAACCATCATCATGAGACATGAGGAGAATGAGATTCCCAGCTGTGACCTGAGCAATTTTGCCCGCCCCAACCCAGT |

TABLE 1A-continued

| NOV1 nucleotide sequence. |
| --- |
| CGTCTCTCCATCCCCACTGACGTCCTTCGCCAGCTCCTGTGCAGAGAAAGGCCCCATTGTGCCGGAAATTCAGGCTTTGCA |
| GGAGGAAATCTCTATCTCTGGCTGCAAGATGAGGCTGAGCTACCTGAGCAGCCGGACCCCTGGCTACAAATCTGTCCTGAG |
| GATCAGCCTCACCCACCCGACCATCCCCTTCAACCTCATGAAGGTGCACCTCATGGTAGCGGTGGAGGGCCGCCTCTTCAG |
| GAAGTGGTTCGCTGCAGCCCCAGACCTGTCCTATTATTTCATTTGGGACAAGACAGACGTCTACAACCAGAAGGTGTTTGG |
| GCTTTCAGAAGCCTTTGTTTCCGTGGGTTATGAATATGAATCCTGCCCAGATCTAATCCTGTGGGAAAAAAGAACAACAGT |
| GCTGCAGGGCTATGAAATTGACGCGTCCAAGCTTGGAGGATGGAGCCTAGACAAACATCATGCCCTCAACATTCAAAGTGG |
| TGGCATCCTGCACAAAGGGAATGGGGAGAACCAGTTTGTGTCTCAGCAGCCTCCTGTCATTGGGAGCATCATGGGCAATGG |
| GCGCCGGAGAAGCATCTCCTGCCCCAGCTGCAACGGCCTTGCTGACGGCAACAAGCTCCTGGCCCCAGTGGCCCTCACCTG |
| TGGCTCTGACGGGAGCCTCTATGTGGGTGATTTCAACTACATTAGAAGGATCTTCCCCTCTGGAAATGTCACCAACATCCT |
| AGAGCTGAGGGTCAGAAATAAAGATTTCAGACATAGTCACAGTCCAGCACACAAATACTACCTGGCCACAGACCCCATGAG |
| TGGGGCCGTCTTCCTTTCTGACAGCAACAGCCGGCGGGTCTTTAAAATCAAGTCCACTGTGGTGGTGAAGGACCTTGTCAA |
| GAACTCTGAGGTGGTTGCGGGGACAGGTGACCAGTGCCTCCCCTTTGATGACACTCGCTGCGGGGATGGTGGGAAGGCCAC |
| AGAAGCCACACTCACCAATCCCAGGGGTCCCCCAGGCATTACAGTGGACAAGTTTGGGCTGATCTACTTCGTGGATGGCAC |
| CATGATCAGACGCATCGATCAGAATGGGATCATCTCCACCCTGCTCGGCTCTAATGATCTCACATCAGCCCGGCCACTCAG |
| CTGTGATTCTGTCATGGATATTTCCCAGGTAAGACAGGTTCACCTGGAGTGGCCCACAGACTTAGCCATCAACCCAATGGA |
| CAACTCACTTTATGTCCTCGACAACAATGTGGTCCTGCAAATCTCTGAAAACCACCAGGTGCGCATTGTCGCCGGGAGGCC |
| CATGCACTGCCAGGTCCCTGGCATTGACCACTTCCTGCTAAGCAAGGTGGCCATCCACGCAACCCTGGAGTCAGCCACCGC |
| TTTGGCTGTTTCACACAATGGGGTCCTGTATATTGCTGAGACTGATGAGAAAAAGATCAACCGCATCAGGCAGGTCACCAC |
| TAGTGGAGAGATCTCACTCGTTGCTGGGGCCCCCAGTGGCTGTGACTGTAAAAATGATGCCAACTGTGATTGTTTTTCTGG |
| AGACGATGGTTATGCCAAGGATGCAAAGTTAAATACCCCATCTTCCTTGGCTGTGTGTGCTGATGGGGAGCTCTACGTGGC |
| CGACCTTGGGAACATCCGAATTCGGTTTATCCGGAAGAACAAGCCTTTCCTCAACACCCAGAACATGTATGAGCTGTCTTC |
| ACCAATTGACCAGGAGCTCTATCTGTTTGATACCACCGGCAAGCACCTGTACACCCAAAGCCTGCCCACAGGAGACTACCT |
| GTACAACTTCACCTACACTGGGGACGGCGACATCACACTCATCACAGACAACAATGGCAACATGGTAAATGTCCGCCGAGA |
| CTCTACTGGGATGCCCCTCTGGCTGGTGGTCCCAGATGGCCAGGTGTACTGGGTGACCATGGGCACCAACAGTGCACTCAA |
| GAGTGTGACCACACAAGGACACGAGTTGGCCATGATCACATACCATGGCAATTCCGGCCTTCTGGCAACCAAAAGCAATGA |
| AAACGGATGGACAACATTTTATGAGTACGACAGCTTTGGCCGCCTGACAAATGTGACCTTCCCTACTGGCCAGGTGAGCAG |
| TTTCCGAAGTGATACAGACAGTTCAGTGCATGTCCAGGTAGAGACCTCCAGCAAGGATGATGTCACCATAACCACCAACCT |
| GTCTGCCTCAGGCGCCTTCTACACACTGCTGCAAGACCAAGTCCGGAACAGCTACTACATCGGGGCCGATGGCTCCTTGCG |
| GCTGCTGCTGGCCAACGGCATGGAGGTGGCGCTGCAGACTGAGCCCCACTTGCTGGCTGGCACCGTCAACCCCACCGTGGG |
| CAAGAGGAATGTCACGCTGCCCATCGACAACGGCCTCAACCTGGTGGAGTGGCGCCAGCGCAAAGAGCAGGCTCGGGGCCA |
| GGTCACTGTCTTTGGGCGCCGGCTGCGGGTGCTCCAGGTTCACAACCGAAATCTCCTATCTCTGGACTTTGATCGCGTAAC |
| ACGCACAGAGAAGATCTATGATGACCACCGCAAGTTCACCCTTCGGATTCTGTACGACCAGGCGGGGCGGCCCAGCCTCTG |
| GTCACCCAGCAGCAGGCTGAATGGTGTCAACGTGACATACTCCCCTGGGGGTTACATTGCTGGCATCCAGAGGGGCATCAT |
| GTCTGAAAGAATGGAATACGACCAGGCGGGCCCCATCACATCCAGGATCTTCGCTGATGGGAAGACATGGAGCTACACATA |
| CTTAGAGAAGGCAGGTGTCCAGTCCATGGTGCTGCTACTACACAGCCAGAGGCAGTATATCTTTGAGTTCGACAAGAATGA |
| CCGCCTCTCTTCTGTGACGATGCCCAACGTGGCGCGGCAGACACTAGAGACCATCCGCTCAGTGGGCTACTACAGAAACAT |
| CTATCAGCCCCCTGAGGGCAATGCCTCAGTCATACAGGACTTCACTGAGGATGGGCACCTCCTTCACACCTTCTACCTGGG |
| CACTGGCCGCAGGGTGATATACAAGTATGGCAAACTGTCAAAGCTGGCAGAGACGCTCTATGACACCACCAAGGTCAGTTT |
| CACCTATGACGAGACGGCAGGCATGCTGAAGACCATCAACCTACAGAATGAGGGCTTCACCTGCACCATCCGCTACCGTCA |

TABLE 1A-continued

| NOV1 nucleotide sequence. |
|---|
| GATTGGGCCCCTGATTGACCGACAGATCTTCCGCTTCACTGAGGAAGGCATGGTCAACGCCCGTTTTGACTACAACTATGA |
| CAACAGCTTCCGGGTGACCAGCATGCAGGCTGTGATCAACGAGACCCCACTGCCCATTGATCTCTATCGCTATGATGATGT |
| GTCAGGCAAGACAGACGAGTTTGGGAAGTTTGGTGTCATTTACTATGACATTAACCAGATCATCACCACAGCTGTCATGAC |
| CCACACCAAGCATTTTGATGCATATGGCAGGATGAAGGAAGTGCAGTATGAGATCTTCCGCTCGCTCATGTACTGGATGAC |
| CGTCCAGTATGATAACATGGGGCGAGTAGTGAAGAAGGAGCTGAAGGTAGGACCCTACGCCAATACCACTCGCTACTCCTA |
| TGAGTATGATGCTGACGGCCAGCTGCAGACAGTCTCCATCAATGACAAGCCACTCTGGCGCTACAGCTACGACCTCAATGG |
| GAACCTGCACTTACTGAGCCCTGGGAACAGTGCACGGCTCACACCACTACGGTATGACATCCGCGACCGCATCACTCGGCT |
| GGGTGACGTGCAATACAAGATGGATGAGGATGGCTTCCTGAGGCAGCGGGGCGGTGATATCTTTGAGTACAACTCAGCTGG |
| CCTGCTCATCAAGGCCTACAACCGGGCTGGCAGCTGGAGTGTCAGGTACCGCTACGATGGCCTGGGGCGGCGCGTGTCCAG |
| CAAGAGCAGCCACAGCCACCACCTGCAGTTCTTCTATGCACACCTCACCAACCCCACCAAGGTCACCCACCTGTACAACCA |
| CTCCAGCTCTGAGATCACCTCCCTCTACTACGACTTGCAAGGACACCTCTTTGCCATGGAGCTGAGCAGTGGTGATGAGTT |
| TTACATAGCTTGTGACAACATCGGGACCCCTCTTGCTGTCTTTAGTGGAACAGGTTTGATGATCAAGCAAATCCTGTACAC |
| AGCCTATGGGGAGATCTACATGGATACCAACCCCAACTTTCAGATCATCATAGGCTACCATGGTGGCCTCTATGATCCACT |
| CACCAAGCTTGTCCACATGGGCCGGCGAGATTATGATGTGCTGGCCGGACGCTGGACTAGCCCAGACCACGAGCTGTGGAA |
| GCACCTTAGTAGCAGCAACGTCATGCCTTTTAATCTCTATATGTTCAAAAACAACAACCCCATCAGCAACTCCCAGGACAT |
| CAAGTGCTTCATGACAGATGTTAACAGCTGGCTGCTCACCTTTGGATTCCAGCTACACAACGTGATCCCTGGTTATCCCAA |
| ACCAGACATGGATGCCATGGAACCCTCCTACGAGCTCATCCACACACAGATGAAAACGCAGGAGTGGGACAACAGCAAGGT |
| AATTCCTGCACAAGGCTGCCAGTCTATCCTCGGGGTACAGTGTGAAGTACAGAAGCAGCTCAAGGCCTTTGTCACCTTAGA |
| ACGGTTTGACCAGCTCTATGGCTCCACAATCACCAGCTGCCAGCAGGCTCCAAAGACCAAGAAGTTTGCATCCAGCGGCTC |
| AGTCTTTGGCAAGGGGGTCAAGTTTGCCTTGAAGGATGGCCGAGTGACCACAGACATCATCAGTGTGGCCAATGAGGATGG |
| GCGAAGGGTTGCTGCCATCTTGAACCATGCCCACTACCTAGAGAACCTGCACTTCACCATTGATGGGGTGGATACCCATTA |
| CTTTGTGAAACCAGGACCTTCAGAAGGTGACCTGGCCATCCTGGGCCTCAGTGGGGGGCGGCGAACCCTGGAGAATGGGGT |
| CAACGTCACTGTGTCCCAGATCAACACAGTACTTAATGGCAGGACTAGACGCTACACAGACATCCAGCTCCAGTACGGGGC |
| ACTGTGCTTGAACACACGCTACGGGACAACGTTGGATGAGGAGAAGGCACGGGTCCTGGAGCTGGCCCGGCAGAGAGCCGT |
| GCGCCAAGCGTGGGCCCGCGAGCAGCAGAGACTGCGGGAAGGGGAGGAAGGCCTGCGGGCCTGGACAGAGGGGGAGAAGCA |
| GCAGGTGCTGAGCACAGGGCGGGTGCAAGGCTACGACGGCTTTTTCGTGATCTCTGTCGAGCAGTACCCAGAACTGTCAGA |
| CAGCGCCAACAACATCCACTTCATGAGACAGAGCGAGATGGGCCGGAGGTGACAGAGAGGACCAAGGACTTCTTGCCAAAG |
| ACAGCTACTCTTTT |

The disclosed NOV1 nucleic acid sequence, localized to chromsome 11, and has 3182 of 3865 bases (82%) identical to a *Mus musculus* Ten-m4 mRNA (gb:GENBANK-ID:AB025413|acc:AB025413.1) (E=0.0). Similiarity information was assessed using public nucleotide databases including all GenBank databases and the GeneSeq patent database. Chromosome information was assigned using OMIM and the electronic northern tool from Curatools to derive the chromosomal mapping of the SeqCalling assemblies, Genomic clones, and/or EST sequences that were included in the invention.

In all BLAST alignments herein, the "E-value" or "Expect" value is a numeric indication of the probability that the aligned sequences could have achieved their similarity to the BLAST query sequence by chance alone, within the database that was searched. For example, the probability that the subject ("Sbjct") retrieved from the NOV1 BLAST analysis, e.g., *Mus musculus* Ten-m4 mRNA, matched the Query NOV1 sequence purely by chance is 0.0. The Expect value (E) is a parameter that describes the number of hits one can "expect" to see just by chance when searching a database of a particular size. It decreases exponentially with the Score (S) that is assigned to a match between two sequences. Essentially, the E value describes the random background noise that exists for matches between sequences.

The Expect value is used as a convenient way to create a significance threshold for reporting results. The default value used for blasting is typically set to 0.0001. In BLAST 2.0, the Expect value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., http://www.ncbi.nlm.nih.gov/Education/BLASTinfo/. Occasionally, a string of X's or N's will result from a BLAST search. This is a result of automatic filtering of the query for low-complexity sequence that is performed to prevent artifactual hits. The filter substitutes any low-complexity sequence that it finds with the letter "N" in nucleotide sequence (e.g., "NNNNNNNN") or the letter "X" in protein sequences (e.g., "XXX"). Low-complexity regions can result in high scores that reflect compositional bias rather than significant position-by-position alignment. Wootton and Federhen Methods Enzymol 266:554–571, 1996.

A NOV1 polypeptide (SEQ ID NO:2) encoded by SEQ ID NO:1 has 2794 amino acid residues and is presented using the one-letter code in Table 1B. Signal P, Psort and/or Hydropathy results predict that NOV1 does not contain a signal peptide and is likely to be localized to the mitochondrial inner membrane with a certainty of 0.8363, to the plasma membrane with a certainty of 0.6500 and to the nucleus with a certainty of 0.6000.

TABLE 1B

Encoded NOV1 protein sequence.

(SEQ ID NO:2)
MDVKERKPYRSLTRRRDAERRYTSSSADSEEGKAPQKSYSSSETLKAYDQDARLAYGSRVKDIVPQEAEEFCRTGANFTLR

ELGLEEVTPPHGTLYRTDIGLPHCGYSMGAGSDADMEADTVLSPEHPVRLWGRSTRSGRSSCLSSRANSNLTLTDTEHENT

ETDHPGGLQNHARLRTPPPPLSHAHTPNQHHAASINSLNRGNFTPRSNPSPAPTDHSLSGEPPAGGAQEPAHAQENWLLNS

NIPLETRNLGKQPFLGTLQDNLIEMDILGASRHDGAYSDGHFLFKPGGTSPLFCTTSPGYPLTSSTVYSPPPRPLPRSTFA

WPAFNLKKPSKYCNWKCAALSAIVISATLVILLAYFVAMHLFGLNWHLQPMEGQMYEITEDTASSWPVPTDVSLYPSGGTG

LETPDRKGKGTTEGKPSSFFPEASFIDSGEIDVGRRASQKIPPGTFWRSQVFIDHPVHLKFNVSLGKAALVGIYGRKGLPP

SHTQFDFVELLDGRRLLTQEARSLEGTPRQSRGTVPPSSHETGFIQYLDSGIWHLAFYNDGKESEVVSFLTTAILDSWALC

LGDGECVSGTCHCFPGFLGPDCSRAACPVLCSGNGQYSKGRCLCFSGWKGTECDVPTTQCIDPQCGGRGICIMGSCACNSG

YKGESCEEADCIDPGCSNHGVCIHGECHCSPGWGGSNCEILKTMCPDQCSGHGTYLQESGSCTCDPNWTGPDCSNEICSVD

CGSHGVCMGGTCRCEEGWTGPACNQRACHPRCAEHGTCRDGKCECSPGWNGEHCTISLAHYLDRVVKLSEGCPGLCNGNGR

CTLDLNGWHCVCQLGWRGAGCDTSMETACGDSKDNDGDGLVDCMDPDCCLQPLCHINPLCLGSPNPLDIIQETQVPVSQQN

LHSFYDRIKFLVGRDSTHIIPGENPFDGGHACVIRGQVMTSDGTPLVGVNISFVNNPLFGYTISRQDGSFDLVTNGGISII

LRFERAPFITQEHTLWLPWDRFFVMETIIMRHEENEIPSCDLSNFARPNPVVSPSPLTSFASSCAEKGPIVPEIQALQEEI

SISGCKMRLSYLSSRTPGYKSVLRISLTHPTIPFNLMKVHLMVAVEGRLFRKWFAAAPDLSYYFIWDKTDVYNQKVFGLSE

AFVSVGYEYESCPDLILWEKRTTVLQGYEIDASKLGGWSLDKHHALNIQSGGILHKGNGENQFVSQQPPVIGSIMGNGRRR

SISCPSCNGLADGNKLLAPVALTCGSDGSLYVGDFNYIRRIFPSGNVTNILELRVRNKDFRHSHSPAHKYYLATDPMSGAV

FLSDSNSRRVFKIKSTVVVKDLVKNSEVVAGTGDQCLPFDDTRCGDGGKATEATLTNPRGPPGITVDKFGLIYFVDGTMIR

RIDQNGIISTLLGSNDLTSARPLSCDSVMDISQVRQVHLEWPTDLAINPMDNSLYVLDNNVVLQISENHQVRIVAGRPMHC

QVPGIDHFLLSKVAIHATLESATALAVSHNGVLYIAETDEKKINRIRQVTTSGEISLVAGAPSGCDCKNDANCDCFSGDDG

YAKDAKLNTPSSLAVCADGELYVADLGNIRIRFIRKNKPFLNTQNMYELSSPIDQELYLFDTTGKHLYTQSLPTGDYLYNF

TYTGDGDITLITDNNGNMVNVRRDSTGMPLWLVVPDGQVYWVTMGTNSALKSVTTQGHELAMMTYHGNSGLLATKSNENGW

TTFYEYDSFGRLTNVTFPTGQVSSFRSDTDSSVHVQVETSSKDDVTITTNLSASGAFYTLLQDQVRNSYYIGADGSLRLLL

ANGMEVALQTEPHLLAGTVNPTVGKRNVTLPIDNGLNLVEWRQRKEQARGQVTVFGRRLRVLQVHNRNLLSLDFDRVTRTE

KIYDDHRKFTLRILYDQAGRPSLWSPSSRLNGVNVTYSPGGYIAGIQRGIMSERMEYDQAGRITSRIFADGKTWSYTYLEK

AGVQSMVLLLHSQRQYIFEFDKNDRLSSVTMPNVARQTLETIRSVGYYRNIYQPPEGNASVIQDFTEDGHLLHTFYLGTGR

RVIYKYGKLSKLAETLYDTTKVSFTYDETAGMLKTINLQNEGFTCTIRYRQIGPLIDRQIFRFTEEGMVNARFDYNYDNSF

RVTSMQAVINETPLPIDLYRYDDVSGKTEQFGKFGVIYYDINQIITTAVMTHTKHFDAYGRMKEVQYEIFRSLMYWMTVQY

DNMGRVVKKELKVGPYANTTRYSYEYDADGQLQTVSINDKPLWRYSYDLNGNLHLLSPGNSARLTPLRYDIRDRITRLGDV

QYKMDEDGFLRQRGGDIFEYNSAGLLIKAYNRAGSWSVRYRYDGLGRRVSSKSSHSHHLQFFYADLTNPTKVTHLYNHSSS

EITSLYYDLQGHLFAMELSSGDEFYIACDNIGTPLAVFSGTGLMIKQILYTAYGEIYMDTNPNFQIIIGYHGGLYDPLTKL

TABLE 1B-continued

| Encoded NOV1 protein sequence. |
|---|
| VHMGRRDYDVLAGRWTSPDHELWKHLSSSNVMPFNLYMFKNNNPISNSQDIKCFMTDVNSWLLTFGFQLHNVIPGYPKPDM |
| DAMEPSYELIHTQMKTQEWDNSKVIPAQGCQSILGVQCEVQKQLKAFVTLERFDQLYGSTITSCQQAPKTKKFASSGSVFG |
| KGVKFALKDGRVTTDIISVANEDGRRVAAILNHAHYLENLHFTIDGVDTHYFVKPGPSEGDLAILGLSGGRRTLENGVNVT |
| VSQINTVLNGRTRRYTDIQLQYGALCLNTRYGTTLDEEKARVLELARQRAVRQAWAREQQRLREGEEGLRAWTEGEKQQVL |
| STGRVQGYDGFFVISVEQYPELSDSANNIHFMRQSEMGRR |

The NOV1 amino acid sequence has 2394 of 2542 amino acid residues (94%) identical to, and 2445 of 2542 amino acid residues (96%) similar to, a *Mus musculus* 2771 amino acid residue TEN-M4 protein (ptnr:SPTREMBL-ACC:Q9WTS7) (E=0.0).

The disclosed NOV1 is expressed in at least the following tissues: Brain, Brain Stem, Coronary Artery, Heart, Kidney, Liver, Lymph node, Mammary gland/Breast, Ovary, Parietal Lobe, Pituitary Gland, Prostate, Synovium/Synovial membrane, Testis, Uterus and Whole Organism. This information was derived by determining the tissue sources of the sequences that were included in the invention including but not limited to SeqCalling sources, Public EST sources, Literature sources, and/or RACE sources.

TABLE 1C

SNPs

| Variant | Nucleotide Position | Base Change | Amino Acid Position | Base Change |
|---|---|---|---|---|
| 13374261 | 86 | A > G | 28 | Asp > Gly |
| 13374262 | 194 | T > C | 64 | Val > Ala |
| 13374263 | 229 | G > A | 76 | Ala > Thr |
| 13374264 | 354 | G > A | 117 | Met > Ile |

NOV1 has homology to the amino acid sequences shown in the BLASTP data listed in Table 1D.

TABLE 1D

BLAST results for NOV1

| Gene Index/ Identifier | Protein/ Organism | Length (aa) | Identity (%) | Positives (%) | Expect |
|---|---|---|---|---|---|
| gi\|16551957\|dbj\|BAB71206.1\|(AK056531) | unnamed protein product [*Homo sapiens*] | 730 | 694/738 (94%) | 695/738 (94%) | 0.0 |
| gi\|7657417\|ref\|NP_035987.2\|(NM_011857) | odd Oz/ten-m homolog 3 (Drosophila); odd Oz/ten-m homolog 1 (Drosophila) [*Mus musculus*] | 2715 | 1856/2809 (66%) | 2204/2809 (78%) | 0.0 |
| gi\|17737739\|ref\|NP_524215.1\|(NM_079491) | Tenascin major; odd-Oz; odd Oz [*Drosophila melanogaster*] | 2515 | 792/2469 (32%) | 1279/2469 (51%) | 0.0 |
| gi\|8922444\|ref\|NP_060574.1\|(NM_018104) | hypothetical protein FLJ10474; hypothetical protein FLJ10886 [*Homo sapiens*] | 1045 | 707/1065 (66%) | 863/1065 (80%) | 0.0 |
| gi\|7023205\|dbj\|BAA91879.1\|(AK001748) | unnamed protein product [*Homo sapiens*] | 964 | 660/985 (67%) | 797/985 (80%) | 0.0 |

Possible small nucleotide polymorphisms (SNPs) found for NOV1 are listed in Table 1C. For this and all following SNP tables, depth represents the number of clones covering the region of the SNP. The putative allele frequence (PAF) is the fraction of these clones containing the SNP. A dash, when shown, means that a base is not present. The sign ">" means "is changed to." Silent means that the indicated SNP does not cause a corresponding amino acid change.

The homology between these and other sequences is shown graphically in the ClustalW analysis shown in Table 1E. In the ClustalW alignment of the NOV1 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

Table 1E. ClustalW Analysis of NOV1

1) NOV1 (SEQ ID NO:2)
2) gi|16551957|dbj|BAB71206.1| (AK056531) unnamed protein product [Homo sapiens] (SEQ ID NO:51)
2) gi|7657417|ref|NP_035987.2| (NM_011857) odd Oz/ten-m homolog 3 (Drosophila); odd Oz/ten-m homolog 1 (Drosophila) [Mus musculus] (SEQ ID NO:52)
3) gi|17737739|ref|NP_524215.1| (NM_079491) Tenascin major; odd-Oz; odd Oz [Drosophila melanogaster] (SEQ ID NO:53)
4) gi|8922444|ref|NP_060574.1| (NM_018104) hypothetical protein FLJ10474; hypothetical protein FLJ10886 [Homo sapiens] (SEQ ID NO:54)
5) gi|7023205|dbj|BAA91879.1| (AK001748) unnamed protein product [Homo sapiens] (SEQ ID NO:55)

```
                     10        20        30        40        50        60        70
             ....|....|....|....|....|....|....|....|....|....|....|....|....|....|
NOV1         MDVKERKPYRSLTRRRDAERRYTS--SSADSEEGKAPQKSYSSSETLKAYDQDAR-LAYGSRVKDIVPQE
gi|16551957| ----------------------------------------------------------------------
gi|7657417|  MDVKERRPYCSLTKSRREKERRYTNSSADNEECRVPTQKSYSSSETLKAFDHDYSRLLYGNRVKDLVHRE
gi|17737739| ----------------------------------------------------------------------
gi|8922444|  ----------------------------------------------------------------------
```

```
gi|7023205|     ----------------------------------------------------------------------

                        80        90       100       110       120       130       140
                ....|....|....|....|....|....|....|....|....|....|....|....|....|....|
NOV1            AEEFCRTGANFTLRELGLEEVTPPHGTLYRTDIGLPHCGYSMGAGSDADMEADTVLSPEHPVRLWGRSTR
gi|16551957|    ----------------------------------------------------------------------
gi|7657417|     ADEYTRQGQNFTLRQLGVCESATRRGVAFCAEMGLPHRGYSISAGSDADTENEAVMSPEHAMRLWGRGVK
gi|17737739|    -----------------------------------------------------MNFRKDLVARCSSPWFG
gi|8922444|     ----------------------------------------------------------------------
gi|7023205|     ----------------------------------------------------------------------

                       150       160       170       180       190       200       210
                ....|....|....|....|....|....|....|....|....|....|....|....|....|....|
NOV1            SGRSSCLSSRANSNLTLTDTEHENTETDHPGGLQNHARLRTPPPPLSHAHTPNQHHAASINSLNRGNFTP
gi|16551957|    ----------------------------------------------------------------------
gi|7657417|     SGRSSCLSSRSNSALTLTDTEHENRSDSESEQPSNNPGQPTLQPLPPSHKQHPAQHHPSITSLNRNSLTN
gi|17737739|    IGSISVLFAFVVMLILLTTTGVIKWNQSPPCSVLVGNEASEVTAAKSTNTDLSKLHNSSVRAKNGQGIGL
gi|8922444|     ----------------------------------------------------------------------
gi|7023205|     ----------------------------------------------------------------------

                       220       230       240       250       260       270       280
                ....|....|....|....|....|....|....|....|....|....|....|....|....|....|
NOV1            RSNPSPAPTDHSLSGEPPAGGAQEPAHAQENWLLNSNIPLETRNLGKQPFLGTLQDNLIEMDILGASRHD
gi|16551957|    ----------------------------------------------------------------------
gi|7657417|     RRNQSPAPPAALPAELQTTP---ESVQLQDSWVLGSNVPLESR---------------------------
gi|17737739|    AQGQSGLGAAGVGSGGGSSAATVTTATS--------NS--------------------------------
gi|8922444|     ----------------------------------------------------------------------
gi|7023205|     ----------------------------------------------------------------------

                       290       300       310       320       330       340       350
                ....|....|....|....|....|....|....|....|....|....|....|....|....|....|
NOV1            GAYSDGHFLFKPGGTSPLFCTTSPGYPLTSSTVYSPPPRPLPRSTFAWPAFNLKKPSKYCNWKCAALSAI
gi|16551957|    ----------------------------------------------------------------------
gi|7657417|     -----HFLFKTGTGTTPLFSTATPGYTMASGSVYSPPTRPLPRNTLSRSAFKFKKSSKYCSWRCTALCAV
gi|17737739|    -------------GTAQGLQSTSASAEATSSAATSSSQSSLTPS---------------LS---SSLAN-
gi|8922444|     ----------------------------------------------------------------------
gi|7023205|     ----------------------------------------------------------------------

                       360       370       380       390       400       410       420
                ....|....|....|....|....|....|....|....|....|....|....|....|....|....|
NOV1            VISATLVILLAYFVAMHLFGLNWHLQPMEGQMYEITEDTASSWPVPTDVSLYPSGGTGLETPDRKGKGTT
gi|16551957|    ----------------------------------------------------------------------
gi|7657417|     GVSVLLAILLSYFIAMHLFGLNWHLQQTENDTFENGKVNSDTVPTNTVS----------------LPSGD
gi|17737739|    ----------------------------------------AN-------------------------NGG
gi|8922444|     ----------------------------------------------------------------------
gi|7023205|     ----------------------------------------------------------------------

                       430       440       450       460       470       480       490
                ....|....|....|....|....|....|....|....|....|....|....|....|....|....|
NOV1            EGKPSSFFPEASFIDSGEIDVGRRASQKIPPGTFWRSQVFIDHPVHLKFNVSLGKAALVGIYGRKGLPPS
gi|16551957|    ----------------------------------------------------------------------
gi|7657417|     NGKLGGFTHENNTIDSGELDIGRRAIQEVPPGIFWRSQLFIDQPQFLKFNISLQKDALIGVYGRKGLPPS
gi|17737739|    ARTFPARSFPPDGTTFGQITLGQKLTKEIQPYSYWNMQFYQSEPAYVKFDYTIPRGASIGVYGRRNALPT
gi|8922444|     ----------------------------------------------------------------------
gi|7023205|     ----------------------------------------------------------------------

                       500       510       520       530       540       550       560
                ....|....|....|....|....|....|....|....|....|....|....|....|....|....|
NOV1            HTQFDFVELLDGRRLLTQEARSLEGTPRQSRGTVPPSSHETGFIQYLDSGIWHLAFYNDGKESEVVSF--
gi|16551957|    ----------------------------------------------------------------------
gi|7657417|     HTQYDFVELLDGSRLIAREQRNLVESERAGRQARSVSLHEAGFIQYLDSGIWHLAFYNDGKNPEQVSFNT
gi|17737739|    HTQYHFKEVLSGFSASTRTARAAHLSITREVTR---YMEPGHWFVSLYN--------DDGDVQELTFYAA
gi|8922444|     ----------------------------------------------------------------------
gi|7023205|     ----------------------------------------------------------------------

                       570       580       590       600       610       620       630
                ....|....|....|....|....|....|....|....|....|....|....|....|....|....|
NOV1            LTTA-ILDSWALCLGDGECVSGTCHCFPGFLGPDCSRAACPVLCSGNGQYSKGRCLCFSGWKGTECDVPT
gi|16551957|    ----------------------------------------------------------------------
gi|7657417|     IVIESVVECPRNCHGNGECVSGTCHCFPGFLGPDCSRAACPVLCSGNGQYSKGRCLCFSGWKGTECDVPT
gi|17737739|    VAEDMTQNCPNGCSGNGQCLLGHCQCNPGFGGDDCSESVCPVLCSQHGEYTNGECICNPGWKGKECSLRH
gi|8922444|     ----------------------------------------------------------------------
gi|7023205|     ----------------------------------------------------------------------

                       640       650       660       670       680       690       700
                ....|....|....|....|....|....|....|....|....|....|....|....|....|....|
NOV1            TQCIDPQCGGRGICIMGSCACNSGYKGESCEEADCIDPGCSNHGVCIHGECHCSPGWGGSNCEILKT---
```

```
gi|16551957|  ----------------------------------------------------------------------
gi|7657417|   TQCIDPQCGGRGICIMGSCACNSGYKGENCEEADCLDPGCSNHGVCIHGECHCNPGWGGSNCEILKT---
gi|17737739|  DECEVADCSGHGHCVSGKCQCMRGYKGKFCEEVDCPHPNCSGHGFCADGTCICKKGWKGPDCATMDQDAL
gi|8922444|   ----------------------------------------------------------------------
gi|7023205|   ----------------------------------------------------------------------

                   710       720       730       740       750       760       770
              ....|....|....|....|....|....|....|....|....|....|....|....|....|....|
NOV1          MCPDQCSGHGTYLQESGSCTCDPNWTGPDCSNEICSVDCGSHGVCMGGTCRCEEGWTGPACNQRACHPRC
gi|16551957|  ----------------------------------------------------------------------
gi|7657417|   MCADQCSGHGTYLQESGSCTCDPNWTGPDCSNEICSVDCGSHGVCMGGSCRCEEGWTGPACNQRACHPRC
gi|17737739|  QCLPDCSGHGTFDLDTQTCTCEAKWSGDDCSKELCDLDCGQHGRCEGDACACDPEWGGEYCNTRLCDVRC
gi|8922444|   ----------------------------------------------------------------------
gi|7023205|   ----------------------------------------------------------------------

                   780       790       800       810       820       830       840
              ....|....|....|....|....|....|....|....|....|....|....|....|....|....|
NOV1          AEHGTCRDGKCECSPGWNGEHCTISLAHYLDRVVKLSEGCPGLCNGNGRCTLDLNG-WHCVCQLGWRGAG
gi|16551957|  ----------------------------------------------------------------------
gi|7657417|   AEHGTCKDGKCECSQGWNGEHCTIAHYLDK----IVKEGCPGLCNSNGRCTLDQNG-WHCVCQPGWRGAG
gi|17737739|  NEHGQCKNGTCLCVTGWNGKHCTIEG-------------CPNSCAGHGQCRVSGEGQWECRCYEGWDGPD
gi|8922444|   ----------------------------------------------------------------------
gi|7023205|   ----------------------------------------------------------------------

                   850       860       870       880       890       900       910
              ....|....|....|....|....|....|....|....|....|....|....|....|....|....|
NOV1          CDTSMETACGDSKDNDGDGLVDCMDPDCCLQPLCHINPLCLGSPNPLDIIQETQVPVSQQNLHSFYDRIK
gi|16551957|  ----------------------------------------------------------------------
gi|7657417|   CDVAMETLCTDSKDNEGDGLIDCMDPDCCLQSSCQNQPYCRGLPDPQDIISQSLQTPSQQAAKSFYDRIS
gi|17737739|  CGIALELNCGDSKDNDKDGLVDCEDPECCASHVCKTSQLCVSAPKPIDVLLRKQP---PAITASFFERMK
gi|8922444|   ----------------------------------------------------------------------
gi|7023205|   ----------------------------------------------------------------------

                   920       930       940       950       960       970       980
              ....|....|....|....|....|....|....|....|....|....|....|....|....|....|
NOV1          FLVGRDSTHIIPGENPFDGGHACVIRGQVMTSDGTPLVGVNISFVNNPLFGYTISRQDGSFDLVTNGGIS
gi|16551957|  ----------------------------------------------------------------------
gi|7657417|   FLIGSDSTHVLPGESPFNKSLASVIRGQVLTADGTPLIGVNVSFLHYSEYGYTITRQDGMFDLVANGGAS
gi|17737739|  FLIDESSLQNYAKLETFNESRSAVIRGRVVTSLGMGLVGVRVSTTTLLEG-FTLTRDDGWFDLMVNGGGA
gi|8922444|   ----------------------------------------------------------------------
gi|7023205|   ----------------------------------------------------------------------

                   990      1000      1010      1020      1030      1040      1050
              ....|....|....|....|....|....|....|....|....|....|....|....|....|....|
NOV1          IILRFERAPFITQEHTLWLPWDRFFVMETIIMRHEENE------IPSCDLSNFARPNPVVSPSPLTSFAS
gi|16551957|  ----------------------------------------------------------------------
gi|7657417|   LTLVFERSPFLTQYHTVWIPWNVFYVMDTLVMKKEEND------IPSCDLSGFVRPSPIIVSSPLSTFFR
gi|17737739|  VTLQFGRAPFRPQSRIVQVPWNEVVIIDLVVMSMSEEKGLAVTTTHTCFAHDYDLMKPVVLASWKHGFQG
gi|8922444|   ----------------------------------------------------------------------
gi|7023205|   ----------------------------------------------------------------------

                  1060      1070      1080      1090      1100      1110      1120
              ....|....|....|....|....|....|....|....|....|....|....|....|....|....|
NOV1          SCAEKGPIVPEIQALQEEISISGCKMRLSYLSSRTPGYKSVLRISLTHPTIPFNLMKVHLMVAVEGRLFR
gi|16551957|  ----------------------------------------------------------------------
gi|7657417|   SSPEDSPIIPETQVLHEETTIPGTDLKLSYLSSRAAGYKSVLKITMTQAVIPFNLMKVHLMVAVVGRLFQ
gi|17737739|  ACPDRSAILAESQVIQESLQIPGTGLNLVYHSSRAAGYLSTIKLQLTPDVIPTSLHLIHLRITIEGILFE
gi|8922444|   ----------------------------------------------------------------------
gi|7023205|   ----------------------------------------------------------------------

                  1130      1140      1150      1160      1170      1180      1190
              ....|....|....|....|....|....|....|....|....|....|....|....|....|....|
NOV1          KWFAAAPDLSYYFIWDKTDVYNQKVFGLSEAFVSVGYEYESCPDLILWEKRTTVLQGYEIDASKLGGWSL
gi|16551957|  ----------------------------------------------------------------------
gi|7657417|   KWFPASPNLAYTFIWDKTDAYNQKVYGLSEAVVSVGYEYESCLDLTLWEKRTAVLQGYELDASNMGGWTL
gi|17737739|  RIFEADPGIKFTYAWNRLNIYRQRVYGVTTAVVKVGYQYTDCTD-IVWDIQTTKLSGHDMSISEVGGWNL
gi|8922444|   ----------------------------------------------------------------------
gi|7023205|   ----------------------------------------------------------------------

                  1200      1210      1220      1230      1240      1250      1260
              ....|....|....|....|....|....|....|....|....|....|....|....|....|....|
NOV1          DKHHALNIQSGGILHKGNGENQFVSQQPPVIGSIMGNGRRRSISCPSCNGLADGNKLLAPVALTCGSDGS
gi|16551957|  ----------------------------------------------------------------------
gi|7657417|   DKHHVLDVQNG-ILYKGNGENQFISQQPPVVSSIMGNGRRRSISCPSCNGQADGNKLLAPVALACGIDGS
gi|17737739|  DIHHRYNFHEG-ILQKGDGSNIYLRNKPRIILTTMGDGHQRPLECPDCDGQATKQRLLAPVALAAAPDGS
gi|8922444|   ----------------------------------------------------------------------
gi|7023205|   ----------------------------------------------------------------------
```

```
                1270      1280      1290      1300      1310      1320      1330
           ....|....|....|....|....|....|....|....|....|....|....|....|....|....|
NOV1        LYVGDFNYIRRIFPSGNVTNILELRVRNKDFRHSHSPAHKYYLATDPMSGAVFLSDSNSRRVFKIKSTVV
gi|16551957| ----------------------------------------------------------------------
gi|7657417| LYVGDFNYVRRIPPSGNVTSVLEL--RNKDFRHSSNPAHRYYLATDPVTGDLYVSDTNTRRIYRPKSLTG
gi|17737739| LFVGDFNYIRRIMTDGSIRTVVKLN--------ATRVSYRYHMALSPLDGTLYVSDPESHQIIRVRDTND
gi|8922444| ----------------------------------------------------------------------
gi|7023205| ----------------------------------------------------------------------

                1340      1350      1360      1370      1380      1390      1400
           ....|....|....|....|....|....|....|....|....|....|....|....|....|....|
NOV1        VKDLVKNSEVVAGTGDQCLPFDDTRCGDGGKATEATLTNPRGPPGITVDKFGLIYFVDGTMIRRIDQNGI
gi|16551957| ----------------------------------------------------------------------
gi|7657417| AKDLTKNAEVVAGTGEQCLPFDEARCGDGGKAVEATL---MSPKGMAIDKNGLIYFVDGTMIRKVDQNGI
gi|17737739| YSQPELNWEAVVGSGERCLPGDEAHCGDGALAKDAKLAY---PKGIAISSDNILYFADGTNIRMVDRDGI
gi|8922444| ----------------------------------------------------------------------
gi|7023205| ----------------------------------------------------------------------

                1410      1420      1430      1440      1450      1460      1470
           ....|....|....|....|....|....|....|....|....|....|....|....|....|....|
NOV1        ISTLLGSNDLTSARPLSCDSVMDISQVRQVHLEWPTDLAINPMDNSLYVLDNNVVLQISENHQVRIVAGR
gi|16551957| ----------------------------------------------------------------------
gi|7657417| ISTLLGSNDLTSARPLTCDTSMHISQVR---LEWPTDLAINPMDNSIYVLDNNVVLQITENRQVRIAAGR
gi|17737739| VSTLIGNHMHKSHWKP--IPCEGTLKLEEMHLRWPTELAVSPMDNTLHIIDDHMILRMTPDGRVRVISGR
gi|8922444| ----------------------------------------------------------------------
gi|7023205| ----------------------------------------------------------------------

                1480      1490      1500      1510      1520      1530      1540
           ....|....|....|....|....|....|....|....|....|....|....|....|....|....|
NOV1        PMHCQVPGIDHFLLSKVAIHATLESATALAVSHNGVLYIAETDEKKINRIRQVTTSGEISLVAGAPSGCD
gi|16551957| ----------------------------------------------------------------------
gi|7657417| PMHCQVPGVEYPVG-KHAVQTTLESATAIAVSYSGVLYITETDEKKINRIRQVTTDGEISLVAGIPSECD
gi|17737739| PLHCATASTAYDTD--LATHATLVMPQSIAFGPLGELYVAESDSQRINRVRVIGTDGRIAPFAGAESKCN
gi|8922444| ----------------------------------------------------------------------
gi|7023205| ----------------------------------------------------------------------

                1550      1560      1570      1580      1590      1600      1610
           ....|....|....|....|....|....|....|....|....|....|....|....|....|....|
NOV1        CKNDANCDCFSGDDGYAKDAKLNTPSSLAVCADGELYVADLGNIRIRFIRKNKPFLNTQNMYELSSPIDQ
gi|16551957| ----------------------------------------------------------------------
gi|7657417| CKNDANCDCYQSGDGYAKDAKLNAPSSLAASPDGTLYIADLGNIRIRAVSKNKPLLNSMNFYEVASPTDQ
gi|17737739| CLERG-CDCFEAEHYLATSAKFNTIAALAVTPDSHVHIADQANYRIRSVMSSIPEASPSREYEIYAPDMQ
gi|8922444| ----------------------------------------------------------------------
gi|7023205| ----------------------------------------------------------------------

                1620      1630      1640      1650      1660      1670      1680
           ....|....|....|....|....|....|....|....|....|....|....|....|....|....|
NOV1        ELYLFDTTGKHLYTQSLPTGDYLYNFTY---TGDGDITLITDNNGNMVNVRRDSTGMPLWLVVPDGQVYW
gi|16551957| ----------------------------------------------------------------------
gi|7657417| ELYIFDINGTHQYTVSLVTGDYLYNFSY---SNDNDVTAVTDSNGNTLRIRRDPNRMPVRVVSPDNQVIW
gi|17737739| EIYIFNRFGQHVSTRNILTGETTYVFTYNVNTSNGKLSTVTDAAGNKVFLLRDYTSQVNSIENTKGQKCR
gi|8922444| ----------------------------------------------------------------------
gi|7023205| ----------------------------------------------------------------------

                1690      1700      1710      1720      1730      1740      1750
           ....|....|....|....|....|....|....|....|....|....|....|....|....|....|
NOV1        VTMGTNSALKSVTTQGHELAMMTYHGNSGLLATKSNENGWTTFYEYDSFGRLTNVTFPTGQVSSFRSDTD
gi|16551957| ----------------------------------------------------------------------
gi|7657417| LTIGTNGCLKSMTAQGLELVLFTYHGNSGLLATKSDETGWTTFFDYDSEGRLTNVTFPTGVVTNLHGDMD
gi|17737739| LRMTRMKMLHELSTPDNYNVTYEYHGPTGLLRTKLDSTGRSYVYNYDEFGRLTSAVTPTGRVIELS----
gi|8922444| --------------------------------------------------------------------MD
gi|7023205| ----------------------------------------------------------------------

                1760      1770      1780      1790      1800      1810      1820
           ....|....|....|....|....|....|....|....|....|....|....|....|....|....|
NOV1        SSTHTQVETSSKD-IVTITTNLSASGLFYTTLLDQVRNSYYCGADGSLRLLLANGMGVALGTEGSLLAGT
gi|16551957| ----------------------------------------------------------------------
gi|7657417| KATTTDIESSSREELVSITSNLSSIDSFYTTVLDQLRNSYQCGYDGSLRIFYASCLLSHYGTEGSVLAGT
gi|17737739| FDLSTKGAQVKVSEIAQKEMSLLIQGLTVIIRNGAAESRTTCDMDGSTTSITPWGHNLQMGVARGTTLAE
gi|8922444| KATTTDIESSSREELVSITSNLSSIDSFYTTVLDQLRNSYQCGYDGSLRIIYASCLLSHYGTEGSVLAGT
gi|7023205| ----------------------------------------------------------------------

                1830      1840      1850      1860      1870      1880      1890
           ....|....|....|....|....|....|....|....|....|....|....|....|....|....|
NOV1        VNETLGL------SNYTLSIDNSLNEVEWHQRS---------EQARGQVTVEGRRLFVLQVHNENLLSGI
gi|16551957| ----------------------------------------------------------------------
```

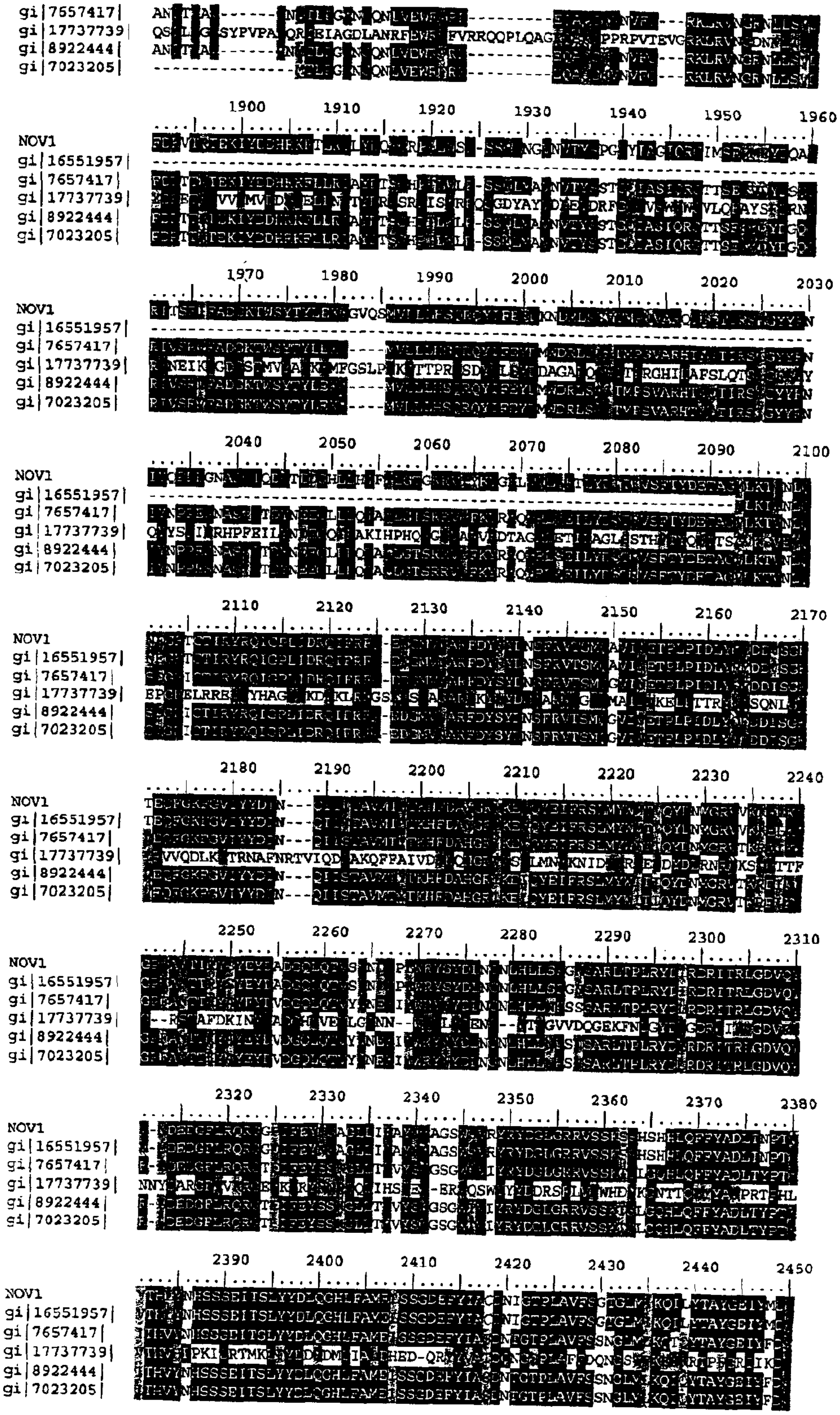

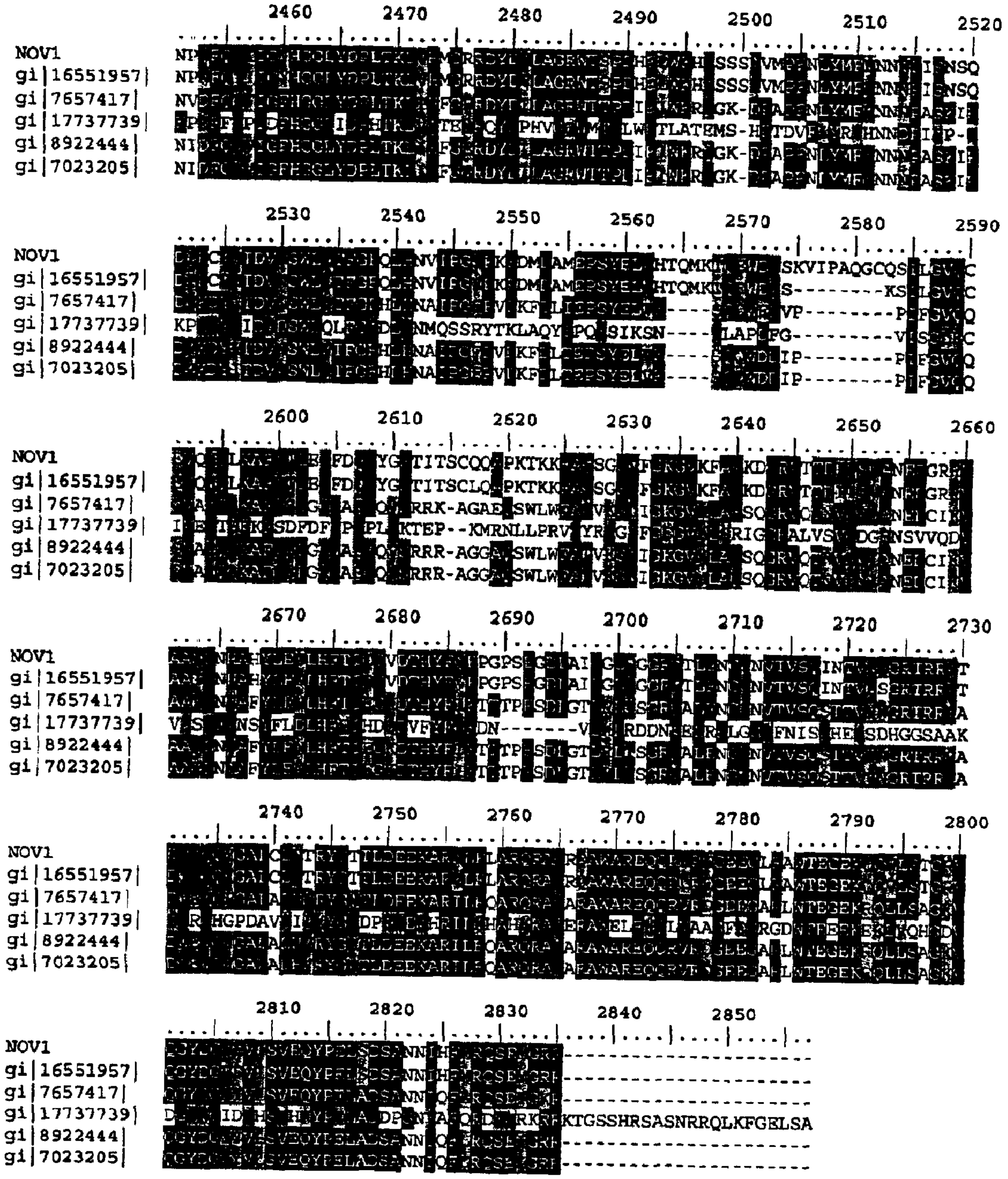
NOV1
gi|16551957|
gi|7657417|
gi|17737739|
gi|8922444|
gi|7023205|

The presence of identifiable domains in NOV1, as well as all other NOVX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for NOV1, as disclosed in Tables 1F, were collected from the *Conserved Domain Database* (CDD) with Reverse Position Specific BLAST analyses. This BLAST analysis software samples domains found in the Smart and Pfam collections. For Tables 1F and all successive DOMAIN sequence alignments, fully conserved single residues are indicated by black shading or by the sign (|) and "strong" semi-conserved residues are indicated by grey shading or by the sign (+). The "strong" group of conserved amino acid residues may be any one of the following groups of amino acids: STA, NEQK, NHQK, NDEQ, QHRK, MILV, MILF, HY, FYW.

Table 1F list the domain description from DOMAIN analysis results against NOV1. This indicates that the NOV1 sequence has properties similar to those of other proteins known to contain these domains.

expression of mouse ten-m genes, with most prominent expression in brain. All four ten-m genes can be expressed in variously spliced mRNA isoforms. The extracellular domain of Ten-m1 fused to an alkaline phosphatase reporter bound to specific regions in many tissues which were partially overlapping with the Ten-m1 immunostaining. Far Western assays and electronmicroscopy demonstrated that Ten-m1 can bind to itself.

Zebrafish ten-m3 and ten-m4 encode proteins highly similar to the product of *Drosophila* pair-rule gene ten(m)/odd Oz (odz). Their products contain eight epidermal growth factor (EGF)-like repeats that resemble mostly those of the extracellular matrix molecule tenascin. During segmentation period, ten-m3 is expressed in the somites, notochord, pharyngeal arches, and the brain, while expression of ten-m4 is mainly restricted to the brain. In the developing brain, ten-m3 and ten-m4 expression delineates several compartments. Interestingly, ten-m3 and ten-m4 show expression patterns complementary to each other in the developing forebrain and midbrain along both rostrocaudal and dorsoventral axes, depending on developmental stages and locations.

TABLE 1F

Domain Analysis of NOV1

```
gnl|Pfam|pfam01500, Keratin_B2, Keratin, high sulfur B2 protein. High
sulfur proteins are cysteine-rich proteins synthesized during the
differentiation of hair matrix cells, and form hair fibers in
association with hair keratin intermediate filaments. This family has
been divided up into four regions, with the second region containing 8
copies of a short repeat. This family is also known as B2 or KAP1.
(SEQ ID NO:56)
Length = 144 residues, 97.2% aligned
Score = 41.6 bits (96), Expect = 6e-04
NOV1:   624 TTQCIDPQCGGRGICIMGSCACNSGYKGESCEEADCIDPGCSNHGVCIHGECHCSPGWGG  683
            |+ |  | |   | |    |      +  || +  |  | ||           | |
01500:    2 TSCCGFPTCSTLGTCGSSCC------QPPSCCQPSCCQPVCSQTTC-------CRPTCFQ   48

NOV1:   684 SNCEILKTMCPDQCSGHGTYLQESGSCTCDPNWTGPDCSNEICSVDCGSHGVCMGGTCR-  742
            |+|    + |   |              |  +     |    |          + |||
01500:   49 SSC-CRPSCCQTSC---------CQPTCCQSSSCQTGCGIGSCRTRWCRPDCRVEGTCLP   98

NOV1:   743 --CEEGWTGPACNQRACHPRCAEHGTCRDGKCE---CSPGWNGEHCT               784
              |    | | |    | |  |+   ||   |    | |      ||
01500:   99 PCCVVSCTPPTC----CQPVSAQASCCRPSYCGQSCCRPACCCFPCT               141
```

The *Drosophila* gene ten-m/odz is the only pair rule gene identified to date which is not a transcription factor. In an attempt to analyze the structure and the function of ten-m/odz in mouse, four murine ten-m cDNAs which code for proteins of 2,700–2,800 amino acids were isolated. All four proteins (Ten-m1–4) lack signal peptides at the NH2 terminus, but contain a short hydrophobic domain characteristic of transmembrane proteins, 300–400 amino acids after the NH2 terminus. About 200 amino acids COOH-terminal to this hydrophobic region are eight consecutive EGF-like domains. Cell transfection, biochemical, and electronmicroscopic studies suggest that Ten-m1 is a dimeric type II transmembrane protein. Expression of fusion proteins composed of the NH2-terminal and hydrophobic domain of ten-m1 attached to the alkaline phosphatase reporter gene resulted in membrane-associated staining of the alkaline phosphatase. Electronmicroscopic and electrophoretic analysis of a secreted form of the extracellular domain of Ten-m1 showed that Ten-m1 is a disulfide-linked dimer and that the dimerization is mediated by EGF-like modules 2 and 5 which contain an odd number of cysteines. Northern blot and immunohistochemical analyses revealed widespread The above defined information for NOV1 suggests that the NOV1 protein may function as a member of a family of novel TEN-M4-like proteins. Therefore, the NOV1 nucleic acids and proteins of the invention are useful in potential therapeutic applications implicated in various diseases and disorders described below and/or other pathologies. For example, the NOV 1 compositions of the present invention will have efficacy for treatment of patients suffering from cancer, trauma, regeneration (in vitro and in vivo), viral/bacterial/parasitic infections, Endocrine dysfunctions, Diabetes, obesity, Growth and reproductive disorders, Von Hippel-Lindau (VHL) syndrome, Alzheimer's disease, Stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain and/or Neuroprotection. The NOV1 nucleic acid encoding TEN-M4-like proteins, and the TEN-M4-like proteins of the invention, or fragments thereof, may further be useful in diagnostic applications, wherein the presence or amount of the nucleic acid or the protein are to be assessed.

NOV2

A disclosed NOV2 nucleic acid of 1024 nucleotides (also referred to as 20422974__0__132__da1) encoding a novel semphorin-like protein is shown in Table 2A. An open reading frame was identified beginning with an ATG initiation codon at nucleotides 33–35 and ending at nucleotides 1022–1024. Putative untranslated regions upstream from the initiation codon and downstream from the termination codon are underlined in Table 2A, and the start and stop codons are in bold letters.

TABLE 2A

| NOV2 Nucleotide Sequence. |
|---|
| (SEQ ID NO:3) |
| CTGGCCTGAAGCTCAGAGCCGGGGCGTGCGCC**ATG**GCCCCACACTGGGCTGTCTGGCTGCTGGCAGCAAGGCTGTGGGGCC |
| TGGGCATTGGGGCTGAGGTGTGGTGGAACCTTGTGCCGCGTAAGACAGTGTCTTCTGGGGAGCTGGCCACGGTAGTACGGC |
| GGTTCTCCCAGACCGGCATCCAGGACTTCCTGACACTGACGCTGACGGAGCCCACTGGGCTTCTGTACGTGGGCGCCCGAG |
| AGGCCCTGTTTGCCTTCAGCATGGAGGCCCTGGAGCTGCAAGGAGCGATCTCCTGGGAGGCCCCCGTGGAGAAGAAGACTG |
| AGTGTATCCAGAAAGGGAAGAACAACCAGACCGAGTGCTTCAACTTCATCCGCTTCCTGCAGCCCTACAATGCCTCCCACC |
| TGTACGTCTGTGGCACCTACGCCTTCCAGCCCAAGTGCACCTACGTCAACATGCTCACCTTCACTTTGGAGCATGGAGAGT |
| TTGAAGATGGGAAGGGCAAGTGTCCCTATGACCCAGCTAAGGACCATGCTGGCCTTCTTGTGGATGGTGAGCTGTACTCGG |
| CCACACTCAACAACTTCCTGGGCACGGAACCCATTATCCTGCGTAACATGGGGCCCCACCACTCCATGAAGACAGAGTACC |
| TGGCCTTTTGGCTCAACGGGGAGCGGGCAGTGGAGTCCGACTGCTATGCCGAGCAGGTGGTGGCTCGTGTGGCCCGTGTCT |
| GCAAGGGCGATATGGGGGGCGCACGGACCCTGCAGAGGAAGTGGACCACGTTCCTGAAGGCGCGGCTGGCATGCTCTGCCC |
| CGAACTGGCAGCTCTACTTCAACCAGCTGCAGGCGATGCACACCCTGCAGGACACCTCCTGGCACAACACCACCTTCTTTG |
| GGGTTTTTCAAGCACAGTGGGGTGACATGTACCTGTCGGCCATCTGTGAGTACCAGTTGGAAGAGATCCAGCGGGTGTTTG |
| AGGGCCCCTATAAGGAGTACCATGAGGAAGCCCAGAAGTGGGACCGCTACAC |

The disclosed NOV2 polypeptide (SEQ ID NO:4) encoded by SEQ ID NO:3 has 805 amino acid residues and is presented in Table 2B using the one-letter amino acid code. Signal P, Psort and/or Hydropathy results predict that NOV2 does not contain a signal peptide and is likely to be localized to the mitochondrial inner membrane with a certainty of 0.8000 and to the plasma membrane with a certainty of 0.7000. The NOV2 polypeptide has an estimated molecular weight of 89454.5.

TABLE 2B

| Encoded NOV2 protein sequence. |
|---|
| (SEQ ID NO:4) |
| MAPHWAVWLLAARLWGLGIGAEVWWNLVPRKTVSSGELATVVRRFSQTGIQDFLTLTLTEPTGLLYVGAREALFAFSMEAL |
| ELQGAISWEAPVEKKTECIQKGKNNQTECFNFIRFLQPYNASHLYVCGTYAFQPKCTYVNMLTFTLEHGEFEDGKGKCPYD |
| PAKDHAGLLVDGELYSATLNNFLGTEPIILRNMGPHHSMKTEYLAFWLNGERAVESDCYAEQVVARVARVCKGDMGGARTL |
| QRKWTTFLKARLACSAPNWQLYFNQLQAMHTLQDTSWHNTTFFGVFQAQWGDMYLSAICEYQLEEIQRVFEGPYKEYHEEA |
| QKWDRYTDPVPSPRPGSCINNWHRRHGYTSSLELPDNILNFVKKHPLMEEQVGPRWSRPLLVKKGTNFTHLVADRVTGLDG |
| ATYTVLFIGTGDGWLLKAVSLGPWVHLIEELQLFDQEPMRSLVLSQSKKLLFAGSRSQLVQLPVADCMKYRSCADCVLARD |
| PYCAWSVNTSRCVAVGGHSGSLLIQHVMTSDTSGICNLRGSKKVRPTPKNITVVAGTDLVLPCHLSSNLAHARWTFGGRDL |
| PAEQPGSFLYDARLQALVVMAAQPRHAGAYHCFSEEQGARLAAEGYLVAVVAGPSVTLEARAPLENLGLVWLAVVALGAVC |
| LVLLLLVLSLRRRLREELEKGAKATERTLVYPLELPKEPTSPPFRPCPEPDEKLWDPVGYYYSDGSLKIVPGHARCQPGGG |
| PPSPPPGIPGQPLPSPTRLHLGGGRNSNANGYVRLQLGGEDRGGLGHPLPELADELRRKLQQRQPLPDSNPEESSV |

NOV2 has homology to the amino acid sequences shown in the BLASTP data listed in Table 2C.

TABLE 2C

BLAST results for NOV2

| Gene Index/ Identifier | Protein/Organism | Length (aa) | Identity (%) | Positives (%) | Expect |
|---|---|---|---|---|---|
| gi\|12698023\|dbj\| BAB21830.1\| (AB051526) | KIAA1739 protein [*Homo sapiens*] | 963 | 697/801 (87%) | 699/801 (87%) | 0.0 |
| gi\|8134699\|sp\| Q64151\|SM4C_MOUSE | Semaphorin 4C precursor (Semaphorin I) (Sema I) (Semaphorin C-like 1) [*Mus musculus*] | 834 | 637/834 (76%) | 677/834 (80%) | 0.0 |
| gi\|17028346\|gb\| AAH17476.1\|AAH17476 (BC017476) | sema domain, immunoglobulin domain (Ig), transmembrane domain TM) and short cytoplasmic domain, (semaphorin) 4C [*Homo sapiens*] | 510 | 452/510 (88%) | 452/510 (88%) | 0.0 |
| gi\|8923346\|ref\|NP_ 060259.1\| (NM_017789) | sema domain, immunoglobulin domain (Ig), transmembrane domain TM; sema domain, immunoglobulin domain (Ig), transmembrane domain (TM) and short cytoplasmic domain, (semaphorin) 4C [*Homo sapiens*] | 510 | 451/510 (88%) | 451/510 (88%) | 0.0 |
| gi\|7305471\|ref\|NP_ 038688.1\| (NM_013660) | sema domain, immunoglobulin domain (Ig), transmembrane domain (TM) and short cytoplasmic domain, (semaphorin) 4D; M-sema G; semaphorin H [*Mus musculus*] | 861 | 263/615 (42%) | 346/615 (55%) | e–124 |

The homology between these and other sequences is shown graphically in the ClustalW analysis shown in Table 2D.

Table 2D. ClustalW Analysis of NOV2

1) Novel NOV2 (SEQ ID NO:4)
2) gi 12698023|dbj|BAB21830.1| (AB051526) KIAA1739 protein [Homo sapiens] (SEQ ID NO:57)
3) gi 8134699|sp Q64151 SM4C_MOUSE Semaphorin 4C precursor (Semaphorin I) (Sema I) (Semaphorin C-like 1) [Mus musculus] (SEQ ID NO:58)
4) gi 17028346|gb AAH17476.1 AAH17476 (BC017476) sema domain, immunoglobulin domain (Ig), transmembrane domain TM) and short cytoplasmic domain, (semaphorin) 4C [Homo sapiens] (SEQ ID NO:59)
5) gi 8923346|ref NP_060259.1| (NM_017789) sema domain, immunoglobulin domain (Ig), transmembrane domain TM; sema domain, immunoglobulin domain (Ig), transmembrane domain (TM) and short cytoplasmic domain, (semaphorin) 4C [Homo sapiens] (SEQ ID NO:60)
6) gi 7305471|ref NP_038688.1| (NM_013660) sema domain, immunoglobulin domain (Ig), transmembrane domain (TM) and short cytoplasmic domain, (semaphorin) 4D; M-sema G; semaphorin H [Mus musculus] (SEQ ID NO:61)

```
                        10        20        30        40        50        60        70
                ....|....|....|....|....|....|....|....|....|....|....|....|....|....|
NOV2            ----------------------------------------------------------------------
gi|12698023|    LCSHLWQPGLGSCWSEGFPEAGSTHSRLCLLLCWTLIEAVGSRAKKEAAAEEAKVGWGCPALRPEVPLTL
gi|8134699|     ----------------------------------------------------------------------
gi|17028346|    ----------------------------------------------------------------------
gi|8923346|     ----------------------------------------------------------------------
gi|7305471|     ----------------------------------------------------------------------

                        80        90       100       110       120       130       140
                ....|....|....|....|....|....|....|....|....|....|....|....|....|....|
NOV2            -------------------------------------------------------MAPHWAVWLLAARLWG
gi|12698023|    RARAISLMASSGRKLWLRYPSFLPAAWICLLPGWERLGRPRWGCQGQRLFQKCPLLPIRGFGWHLLVAWG
```

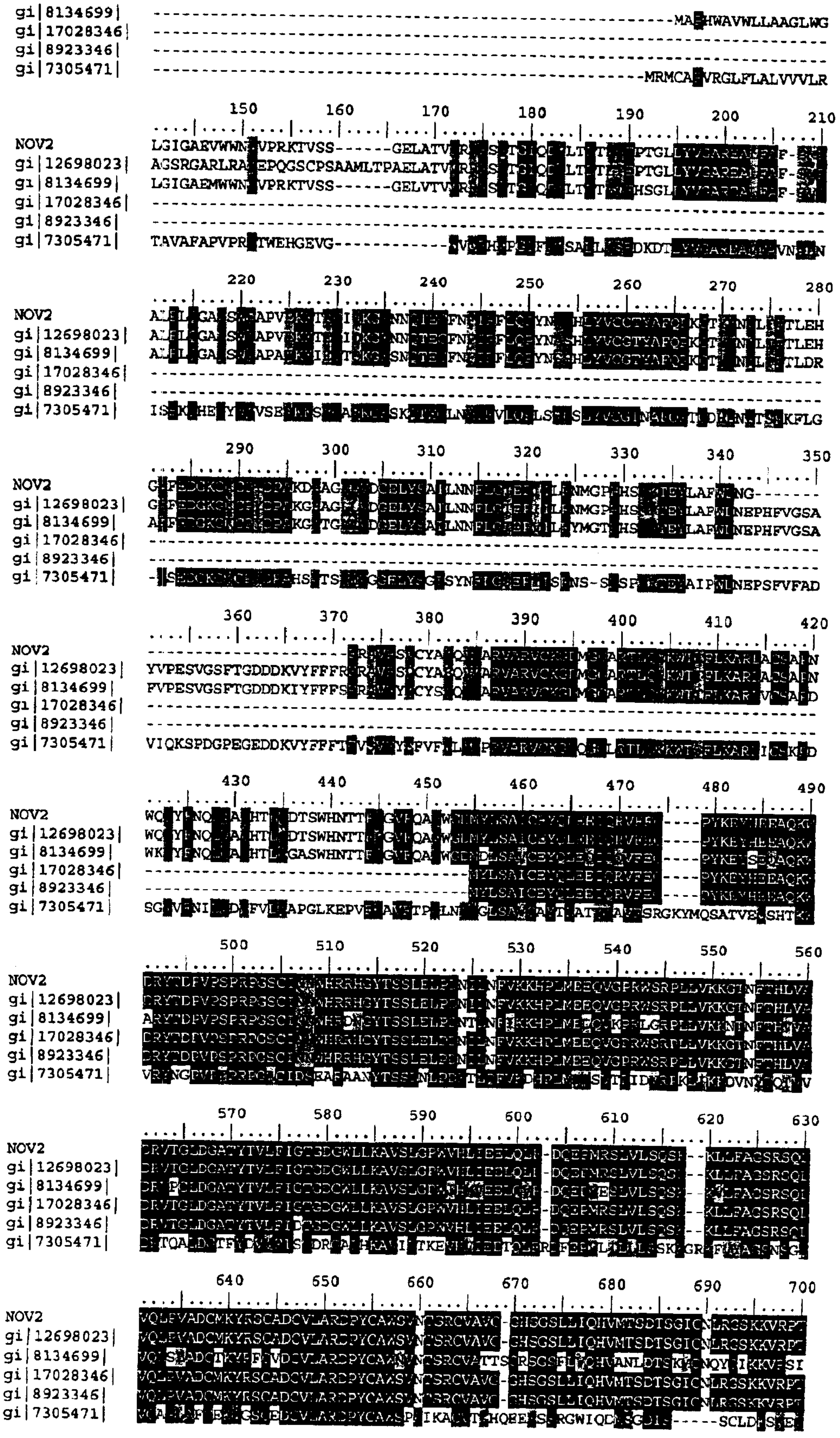

```
gi|8134699|    ---------------------------------------------MAHHWAVWLLAAGLWG
gi|17028346|   ----------------------------------------------------------------
gi|8923346|    ----------------------------------------------------------------
gi|7305471|    ------------------------------------------MRMCAHVRGLFLALVVVLR

                        150       160       170       180       190       200       210
                ....|....|....|....|....|....|....|....|....|....|....|....|....|....|
NOV2           LGIGAEVWWN VPRKTVSS------GELATVR ST Q LT T PTGLLYVAREA F-
gi|12698023|   AGSRGARLRA EPQGSCPSAAMLTPAELATVR ST Q LT T PTGLLYVAREA F-
gi|8134699|    LGIGAEMWWN VPRKTVSS------GELVTVR ST Q LT T HSGL YVAR A F-
gi|17028346|   ----------------------------------------------------------------
gi|8923346|    ----------------------------------------------------------------
gi|7305471|    TAVAFAPVPR TWEHGEVG----------- V H PS F SA L DKDT YVA  A A  VN N

                        220       230       240       250       260       270       280
                ....|....|....|....|....|....|....|....|....|....|....|....|....|....|
NOV2           AL L GA SS APVK TS  I KG NN  E FN  F  Y N  YVCC YAFQ K T N L  TLEH
gi|12698023|   AL L GA SS APVK TS  I KG NN  E FN  F  Y N  YVCG YAFQ K T N L  TLEH
gi|8134699|    AL L GA S  APA K T KG SN E  FN  F  Y N  YVCG YAFQ K T N L  TLDR
gi|17028346|   ----------------------------------------------------------------
gi|8923346|    ----------------------------------------------------------------
gi|7305471|    ISSK HE Y  VSE  S  A K SK  LN  VLQ LS S VR  N  TD N T SKFLG

                        290       300       310       320       330       340       350
                ....|....|....|....|....|....|....|....|....|....|....|....|....|....|
NOV2           G PEDKG     KD AG   DELY A LNN   E  L NMGP HS  TE LAF NG-------
gi|12698023|   G PEDKG     KG AG   DGELY A LNN   E  L NMGP HS  TE LAF NEPHFVGSA
gi|8134699|    A  PEDKG    DKG TG   DGELY A LNN   E  IL YMGT HS  TE LAF NEPHFVGSA
gi|17028346|   ----------------------------------------------------------------
gi|8923346|    ----------------------------------------------------------------
gi|7305471|    - SE CK V  HS T  G  SELY G SYN  G E  SNS-S SP  GE AIP NEPSFVFAD

                        360       370       380       390       400       410       420
                ....|....|....|....|....|....|....|....|....|....|....|....|....|....|
NOV2           ----------------R V SQ CYA Q   ARVARVCK M A  LQ   WI FLKAR A SA N
gi|12698023|   YVPESVGSFTGDDDKVYFFFR V SQ CYA Q   ARVARVCK M A  LQ   WI FLKAR A SA N
gi|8134699|    FVPESVGSFTGDDDKIYFPFS R  Y CYS Q   ARVARVCK M A  LQ   WI FLKAR V SA D
gi|17028346|   ----------------------------------------------------------------
gi|8923346|    ----------------------------------------------------------------
gi|7305471|    VIQKSPDGPEGEDDKVYFPFT V S Y SPVF L   P VARV K  Q  TL  RK T FLKAR  G SK D

                        430       440       450       460       470       480       490
                ....|....|....|....|....|....|....|....|....|....|....|....|....|....|
NOV2           WC YF NQ  A HT  DTSWHNTT  G V QA  W MY SA C V I H  QRV F ----PYKEY H  AQK
gi|12698023|   WC YF NQ  A HT  DTSWHNTT  G V QA  W MY SA C V I H  QRV F ----PYKEY H  AQK
gi|8134699|    WK YF NQ  A HT  GASWHNTT  G V QA  W D SA C YQ L E  QRV F ----PYKEY S  AQK
gi|17028346|   -----------------------------MYLSAI C YQ L EE  QRV F ----MYLSAI C YQ L EE  QRV F
gi|8923346|    ----------------------------------------------------------------
gi|7305471|    SG VE NI  D  FV   APGLKEPVE  A  TP LN  G SA  N T AT  A  SRGKYMQSATVE SHT

                        500       510       520       530       540       550       560
                ....|....|....|....|....|....|....|....|....|....|....|....|....|....|
NOV2           DRYTDFVPSPRPGSCI  MHRRHGYTSSLELP  NT N FVKKHPLMEEQVGPRWSRPLLVKKGTNFTHLV
gi|12698023|   DRYTDFVPSPRPGSCI  MHRRHGYTSSLELP  NT N FVKKHPLMEEQVGPRWSRPLLVKKGTNFTHLV
gi|8134699|    ARYTDFVPSPRPGSCI  MHR HGYTSSLELP  NT AN FKKKHPLMEEQ PLGRPLLVKK TNF HV
gi|17028346|   DRYTDFVPSPRPGSCI  MHRRHGYTSSLELP  NT N FVKKHPLMEEQVGPRWSRPLLVKKGTNFTHLV
gi|8923346|    DRYTDFVPSPRPGSCI  MHRRHGYTSSLELP  NT N FVKKHPLMEEQVGPRWSRPLLVKKGTNFTHLV
gi|7305471|    VR NGPV  PRPG ID EA AAN TS N PF  TD F  DH LM  S  TID  I K  K  DVNF  Q V

                        570       580       590       600       610       620       630
                ....|....|....|....|....|....|....|....|....|....|....|....|....|....|
NOV2           DR VTGLDGATYTVLF IGT DGWLLKAVSLGPAVHLIEELQL -DQEPMRSLVLSQS --KLLFAGSRSQL
gi|12698023|   DR VTGLDGATYTVLF IGT DGWLLKAVSLGPAVHLIEELQL -DQEPMRSLVLSQS --KLLFAGSRCQL
gi|8134699|    DR   GLDGATYTVLF IGT GDCWLLKAVSLGP VH  EELQ L -DQE M  LVLSQS --  FAGSRCQL
gi|17028346|   DR VTGLDGATYTVLF IGT DGWLLKAVSLGPWVHLIEELQL -DQEPMRSLVLSQS --KLLFAGSRSQL
gi|8923346|    DR VTGLDGATYTVLF IGT DGWLLKAVSLGPWVHLIEELQL -DQEPMRSLVLSQS --KLLFAGSRSQL
gi|7305471|    D  QA D  TF DV  IS  DR  A H AL I  TKE M  EE  QL  R FE  L  LS  SK GR F  A  NS G

                        640       650       660       670       680       690       700
                ....|....|....|....|....|....|....|....|....|....|....|....|....|....|
NOV2           VQLFVADCMKYRSCADCVLARDPYCAWSV   SRCVAVG -GHSGSLLIQHVMTSDTSGIC LRGSKKVRPT
gi|12698023|   VQLFVADCMKYRSCADCVLARDPYCAWSV   SRCVAVG -GHSGSLLIQHVMTSDTSGIC LRGSKKVRPT
gi|8134699|    VQ S  ADC KYF FVDCVLARDPYCAA N  SRCVATT SRGSE  QH ANLDTS KF NQY IKKVESI
gi|17028346|   VQLFVADCMKYRSCADCVLARDPYCAWSV   SRCVAVG -GHSGSLLIQHVMTSDTSGIC LRGSKKVRPT
gi|8923346|    VQLFVADCMKYRSCADCVLARDPYCAWSV   SRCVAVG -GHSGSLLIQHVMTSDTSGIC LRGSKKVRPT
gi|7305471|    V  F  E  V  DC VLARDPYCAA P  IKA  TH QEE S RGWIQD GI -----SCLD SK
```

```
                       710       720       730       740       750       760       770
               ....|....|....|....|....|....|....|....|....|....|....|....|....|....|
NOV2           FFNITVVAGTDLVLPCHLSSNLAHARWTFGGRDLPAEQPGSFLYDARLQALVVMAAQPRHAGAYHCFSEE
gi|12698023|   FFNITVVAGTDLVLPCHLSSNLAHARWTFGGRDLPAEQPGSFLYDARLQALVVMAAQPRHAGAYHCFSEE
gi|8134699|    FFNITVVSGTDLVLPCHLSSNLAHAHWTFGSSDLPAEQIGSFLYDTGLQALVVMAAQSRHSGPYRCSSEE
gi|17028346|   FFNITVVAGTDLVLPCHLSSNLAHARWTFGGRDLPAEQPGSFLYDARLQALVVMAAQPRHAGAYHCFSEE
gi|8923346|    FFNITVVAGTDLVLPCHLSSNLAHARWTFGGRDLPAEQPGSFLYDARLQALVVMAAQPRHAGAYHCFSEE
gi|7305471|    FNNHFFKHGGTAELKCFQKSNLARVVWKFQNGDLKAASPKYGFVGR--QHLVVFNLSDGDAGVYQCLSEE

                       780       790       800       810       820       830       840
               ....|....|....|....|....|....|....|....|....|....|....|....|....|
NOV2           Q----------ARLAAEGYLVAVVAGPSVTLEARAPLENLGLVWLAVVALGAVCLVLLLLVLSLRRRLRE
gi|12698023|   Q----------ARLAAEGYLVAVVAGPSVTLEARAPLENLGLVWLAVVALGAVCLVLLLLVLSLRRRLRE
gi|8134699|    Q----------TRLAAPSYLVAVVAGSSVTLEARAPLENLGLVWLAVVALGAVCLVLLLLVLSLRRRLRE
gi|17028346|   Q----------ARLAAEGYLVAVVAGPSVTLEARAPLENLGLVWLAVVALGAVCLVLLLLVLSLRRRLRE
gi|8923346|    Q----------ARLAAEGYLVAVVAGPSVTLEARAPLENLGLVWLAVVALGAVCLVLLLLVLSLRRRLRE
gi|7305471|    QVRNKTVSQLLARHVLEVKLVPRTPPSPTTEEVRTEGSNLTSKMPVGSTQGASPPTPALWATSPRAATLP

                       850       860       870       880       890       900       910
               ....|....|....|....|....|....|....|....|....|....|....|....|....|
NOV2           ELRPGARATERTLVYPLELPKEPTSPPFRPCPEPDEKLWDPVGYYYSDGSLKIVPGHARCQPGGGPPSPE
gi|12698023|   ELRPGAKATERTLVYPLELPKEPTSPPFRPCPEPDEKLWDPVGYYYSDGSLKIVPGHARCQPGGGPPSPE
gi|8134699|    ELRPGARASERTLVYPLELPKEPASPPFRPGPETDEKLWDPVGYYYSDGSLKIVPGHARCQPGGGPPSPE
gi|17028346|   ELEPGRRATERTLVYPLELPKEPTSPPFRPCPEPDEKLWDPVGYYYSDGSLKIVPGHARCQPGGGPPSPE
gi|8923346|    ELRPGARATERTLVYPLELPKEPTSPPFRPCPEPDEKLWDPVGYYYSDGSLKIVPGHARCQPGGGPPSPE
gi|7305471|    PKSSSGTACEPKLVINTVPQLHSEKTVPLKSSPNRLLLSLLPFIYVLFLCSFSYNCPKGYLQPQCLKFRS

                       920       930       940       950       960       970       980
               ....|....|....|....|....|....|....|....|....|....|....|....|....|
NOV2           PSIPGQPLPSS--TRLHLGGGFNSNPNGYVRLQLGGEDRGGLGHPLPELADELRRKLQQRQPLPDSNPEE
gi|12698023|   PSIPGQPLPSS--TRLHLGGGFNSNPNGYVRLQLGGEDRGGLGHPLPELADELRRKLQQRQPLPDSNPEE
gi|8134699|    PSIPGQPLPSS--TRLHLGGGFNSNPNGYVRLQLGGEDRGGSGHPLPELADELRRKLQQRQPLPDSNPEE
gi|17028346|   PSIPGQPLPSS--TRLHLGGGFNSNPNGYVRLQLGGEDRGGLGHPLPELADELRRKLQQRQPLPDSNPEE
gi|8923346|    PSIPGQPLPSS--TRLHLGGGFNSNPNGYVRLQLGGEDRGGLGHPLPELADELRRKLQQRQPLPDSNPEE
gi|7305471|    ALILGQKTPKSDFTDLEQSVKENLNENGSFSQQNGDHPRPALDTGYETEQDTLTSKLPTDQEDSQRNDEL

                       990      1000
               ....|....|....|....|...
NOV2           SS---------------------
gi|12698023|   SS---------------------
gi|8134699|    SS---------------------
gi|17028346|   SS---------------------
gi|8923346|    SS---------------------
gi|7305471|    SSRDKPFDVKCELKFADSDADGD
```

Tables 2E and 2F list the domain description from DOMAIN analysis results against NOV2. This indicates that the NOV2 sequence has properties similar to those of other proteins known to contain these domains.

TABLE 2E

Domain Analysis of NOV2

```
gnL|Pfam|pfam01403, Sema, Sema domain. The Sema domain occurs in
semaphorins, which are a large family of secreted and transmembrane
proteins, some of which function as repellent signals during axon
guidance. Sema domains also occur in the hepatocyte growth factor
receptor. (SEQ ID NO:62)
Length = 433 residues, 97.0% aligned
Score = 405 bits (1040), Expect = 6e-114
NOV2:     66 YVGAREALFAFSMEALE--LQGAISWEAPVEKKTECIQKGKNNQTECFNFIRFLQPYNAS   123
             |||||  ++  ++| |   |     |    |   ||  |||+  ||| |||| || || +
01403:    14 YVGARNRVYVLNLEDLSEVLNLKTGWPGSCETCEECNMKGKSPLTECTNFIRVLQAYNDT    73

NOV2:    124 HLYVCGTYAFQPKCTYVNMLT-FTLEHGEFEDGKGKCPYDPAKDHAGLLV-DGELYSATL   181
             ||||||| |||| || +|+   |+|+    ||| | |||||  +   +||  ||||| |+
01403:    74 HLYVCGTNAFQPVCTLINLGDLFSLDVDNEEDGCGDCPYDPLGNTTSVLVQGGELYSGTV   133

NOV2:    182 NNFLGTEPIILRNMGPHHSMKTE-YLAFWLNG-------------------------ERA   215
              +| | +| | | +| |  ++|| + + |||                          | |
01403:   134 IDFSGRDPSIRRLLGSHDGLRTEFHDSKWLNLPNFVDSYPIHYVHSFSDDKVYFFFRETA   193

NOV2:    216 VESDCYAEQVVARVARVCKGDMGGARTLQR-KWTTFLKARLACSAP--NWQLYFNQLQAM   272
             ||     + + +||||||| | ||   |+  |||||||||| || |      |||+|||
01403:   194 VEDSNC-KTIHSRVARVCKNDPGGRSYLELNKWTTFLKARLNCSIPGEGTPFYFNELQAA   252

NOV2:    273 HTLQDTSWHNTTFFGVFQAQWGDMYLSAICEYQLEEIQRVFEGPYKEYHEEAQKWDRYTD   332
               |   +  +   +|||         ||+| + + +| +|||||+|       ||  |
01403:   253 FVLPTGADTDPVLYGVFTTSSNSSAGSAVCAFSMSDINQVFEGPFKHQSPN-SKWLPYRG   311

NOV2:    333 PVPSPRPGSCINNWHRRHGYTSSLELPDNILNFVKKHPLMEEQVGPRWSRPLLVKKGTN-   391
              || |||| | |         | | |||+ |||++ ||||+| | |  + || | +  |
01403:   312 KVPQPRPGQCPNA--------SGLNLPDDTLNFIRCHPLMDEVVPPLHNVPLFVGQSGNY   363

NOV2:    392 -FTHLVADRVTGLDGATYTVLFIGTGDGWLLKAVSLG------PWVHLIEELQLF-DQEP   443
               | +  |||   ||  |||||+|| || +|| | |         | ++||  +| | ||
01403:   364 RLTSIAVDRVRAGDGQIYTVLFLGTDDGRVLKQVVLSRSSSASYLVVVLEESLVFPDGEP   423

NOV2:    444 MRSLVLSQSK                                                   453
             ++ +|+|
01403:   424 VQRMVISSKN                                                   433
```

TABLE 2F

Domain Analysis of NOV2

```
gnl|Smart|smart00630, Sema, semaphorin domain (SEQ ID NO:63)
Length = 430 residues, 97.0% aligned
Score = 397 bits (1021), Expect = 1e-111
NOV2:     66 YVGAREALFAFSMEALELQG-AISWEAPVEKKTECIQKGKNNQTECFNFIRFLQPYNASH   124
             |||||  |+  |+  +                 ||+ |||+  |+| |||| |  ||| |
00630:    14 YVGARNRLYVLSLNLISEAEVKTGPVLSSPDCEECVSKGKDPPTDCVNFIRLLLDYNADH    73

NOV2:    125 LYVCGTYAFQPKCTYVNMLTFTLEHGEFEDGKGKCPYDPAKDHAGLLVDGELYSATLNNF   184
             | |||| |||| |  +|+          | |+|+||+||  +   +|||||||  |+ +|
00630:    74 LLVCGTNAFQPVCRLINLGNLDRLEVGRESGRGRCPFDPQHNSTAVLVDGELYVGTVADP   133

NOV2:    185 LGTEPIILRNMGPHH-------SMKTE-YLAFWLNG-------------------ERAVES   218
              |++| | |++           |++|  | + |||                   | |||
00630:   134 SGSDPAIYRSLSVRRLKGTSGPSLRTVLYDSRWLNEPNFVYAFESGDFVYFFFRETAVED   193

NOV2:    219 DCYAEQVVARVARVCKGDMGGARTLQRKWTTFLKARLACSAPNW-QLYFNQLQAMHTLQD   277
             +   + ||+||||||| |+|| |+| +|||+|||||| || |     |||+|||   |
00630:   194 ENCGKAVVSRVARVCKNDVGGPRSLSKKWTSFLKARLECSVPGEFPFYFNELQAAFLLPA   253

NOV2:    278 TSWHNTTFFGVFQAQWGDMYLSAICEYQLEEIQRVFEGPYKEYHEEAQKWDRY-TDPVPS   336
              |  +   +|||      +  ||+| + | +|  ||  |+||      +|  |    ||
00630:   254 GSESDDVLYGVFSTSSNPIPGSAVCAFSLSDINAVFNEPFKECETGNSQWLPYPRGLVPF   313

NOV2:    337 PRPGSCINNWHRRHGYTSSLELPDNILNFVKKHPLMEEQVGPRWSRPLLVKKGTN--FTH   394
             ||||+| |         || +|||++|||+| ||||+| | |   ||| ||  +|   |
00630:   314 PRPGTCPNTPL------SSKDLPDDVLNFIKTHPLMDEVVQPLTGRPLFVKTDSNYLLTS   367
```

TABLE 2F-continued

Domain Analysis of NOV2

```
NOV2:   395 LVADRVTGLDGATYTVLFIGTGDGWLLKAVSLGP----WVHLIEELQLFDQ-EPMRSLVL   449
            +  |||    ||   |||||+|| || +|| |          ++||+ +||    |+  |||
00630:  368 IAVDRVR-TDGGNYTVLFLGTSDGRILKVVLSRSSSSSESVVLEEISVFDPGSPVSDLVL   426

NOV2:   450 SQSK                                                           453
            |  |
00630:  427 SPKK                                                           430
```

Members of the collapsin/semaphorin gene family have been proposed to act as growth cone guidance signals in vertebrates and invertebrates. To identify candidate molecules involved in axonal pathfinding during mouse embryogenesis, cDNAs from five new members of the semaphorin family (Sem A-Sem E) were isolated. The murine semaphorin genes are differentially expressed in mesoderm and neuroectoderm before and during the time when axons select their pathways in the embryo. In explant cultures, recombinant Sem D/collapsin converts a matrix permissive for axonal growth into one that is inhibitory for neurites of peripheral ganglia. Studies demonstrate that semaphorins are a diverse family of molecules that may provide local signals to specify territories nonaccessible for growing axons. (Puschel et al., Murine semaphorin D/collapsin is a member of a diverse gene family and creates domains inhibitory for axonal extension. Neuron 14(5):941–8, 1995).

The above defined information for NOV2 suggests that this NOV2 protein may function as a member of the semaphorin protein family. Therefore, the NOV2 nucleic acids and proteins of the invention are useful in potential therapeutic applications implicated in various diseases and disorders and/or other pathologies. For example, the NOV2 compositions of the present invention will have efficacy for treatment of patients suffering from various diseases and disorders. The NOV2 nucleic acid encoding semaphorin-like protein, and the semaphorin-like protein of the invention, or fragments thereof, may further be useful in diagnostic applications, wherein the presence or amount of the nucleic acid or the protein are to be assessed.

NOV3

A disclosed NOV3 nucleic acid of 1933 nucleotides (also referred to as CG50351-01) encoding a novel erythroid membrane-associated protein (ERMAP)-like protein is shown in Table 3A. An open reading frame was identified beginning with a ATG initiation codon at nucleotides 100–102 and ending with a TAG codon at nucleotides 1837–1839. Putative untranslated regions upstream from the initiation codon and downstream from the termination codon are underlined in Table 3A, and the start and stop codons are in bold letters.

TABLE 3A

NOV3 Nucleotide Sequence (SEQ ID NO:5)

AACTTCACCCCAGCCTTGCAAAGTACAGTCACCTAGTTGGTGTTGTAATTGTGACTTCAAAAGGCCATTCCACCATTCTG

TCAATCCAGCTGATTCAGTATGATGGAGAACATGGTAAAACCAGTGAATTCCATGAGCATGAGCCCACTGCCGCACGTCT

TTAGCCGTAAAGTGAGTGCTTTGGTCAGAGGCAATCCTCCATCTCCAGGCTCTGCTGCCACTTCAGGCTTTTCCTTGTGG

GTATCTCAGCCTCCTAGCCAGCCATGGGGGGATGCCGGCAAGTTCCACGTGGCCCTACTAGGGGGCACAGCCGAGCTGCT

CTGCCCTCTCTCCCTCTGGCCCGGGACGGTACCCAAGGAGGTGAGGTGGCTGCGGTCCCCATTCCCGCAGCGCTCCCAGG

CTGTTCACATATTCCGGGATGGGAAGGACCAGGATGAAGATCTGATGCCGGAATATAAGGGGAGGACGGTGCTAGTGAGA

GATGCCCAAGAGGGAAGTGTCACTCTGCAGATCCTTGACGTGCGCCTTGAGGACCAAGGGTCTTACCGATGTCTGATCCA

AGTTGGAAATCTGAGTAAAGAGGACACCGTGATCCTGCAGGTTGCAGCATTTCTGATAAGGAAGGAACTCCTGGTGTGCA

GATCGGTGGGATGGTTCCCAGAGCCCTGGGCCAAGTGGAGAGAACCTCAAGGCAGGGTACTTCCATCCCTGTCAGAGGCC

CACTCTCTGGAAAAAGCTGGGCTCTTCCAAATAGCAGTGTCTAGCAGAGTCAGGGACAGCACACTGGGGAATGTGTCCTG

CACCATCCACAACATGGCCCTTGGCCAAGAGAAGACCACAGCTGTGGTCATATCAGCCCCATCTGTGGGGAGTCTCTCCC

CCTCAGCAGTGGCTCTGGCTGTGATCCTGCCTGTCCTGGTACTTCTCATCATGGTGTGCCTTTGCCTTATCAAGGCAGTG

GCAAAAAATCTCATTATCTTTTCCTTTCTTCCTCTAGACAATCTTCTTTCAGACCATGCTAAAGAAAAAGGTAATGATAT

AAAAGTAGGGAACGTTTCTTCTTTCATAGAGTTGAAAAGAGCTGCAGCAAACTCAGGCTGGAGAAGAGCCCGGTTGCATT

TTGTGGCAGTGACCCTGGACCCAGACACAGCACATCCCAAACTCATCCTTTCTGAGGACCAAAGATGTGTAAGGCTTGGA

GACAGACGGCAGCCTGTACCTGACAACCCCCAGAGATTTGATTTCGTTGTCAGCATCCTAGGCTCTGAGTACTTCACGAC

TABLE 3A-continued

| NOV3 Nucleotide Sequence |
|---|
| TGGCTGCCACTACTGGGAGGTGTATGTGGGAGACAAGACCAAATGGATTCTTGGAGTATGTAGTGAGTCAGTGAGCAGGA |
| AGGGGAAGGTTACTGCCTCACCTGCCAATGGACACTGGCTTCTGCGACAGAGTCGTGGGAATGAGTATGAAGCTCTCACA |
| TCCCCGCAGACCTCCTTCCGCCTTAAAGAGCCTCCACGGTGTGTGGGGATTTTCCTGGACTATGAAGCAGGAGTCATCTC |
| TTTCTACAATGTGACCAACAGTCCCACATCTTTACTTTCACCCACAATTTCTCTGGCCCCCTTCGCCCTTTCTTTGAAC |
| CTTGCCTTCATGATGGAGGAAAAAACACAGCACCTCTAGTCATTTGTTCAGAACTACACAAATCAGAGGAATCAATTGTC |
| CCCAGGCCAGAAGGGAAAGGCCATGCTAATGGAGATGTGTCCCTCAAGGTGAACTCTTCTTTACTACCCCCGAAGGCCCC |
| AGAGCTGAAGGATATAATCCTGTCCTTGCCCCCTGACCTTGGCCCAGCCCTTCAGGAGCTCAAGGCTCCTTCTTTT**TAG**G |
| GATATGCCACATTACCTGCTCCCATCACCATCCAGCCCAGCACCCTGGACTTCAGTCGCCTGGCCCAACCCCATGATTAT |
| GGAACGTCTCTTC |

The disclosed NOV3 nucleic acid sequence maps to chromosome 13 and has 727 of 892 bases (81%) identical to a *Mus musculus* G. domesticus erythroid membrane-associated protein ERMAP mRNA (gb:GENBANK-ID:AF 153906|acc:AF 153906.1) (E=3.7e$^{-199}$).

A disclosed NOV3 protein (SEQ ID NO:6) encoded by SEQ ID NO:5 has 579 amino acid residues, and is presented using the one-letter code in Table 3B. Signal P, Psort and/or Hydropathy results predict that NOV3 does not contain a signal peptide, and is likely to be localized to the plasma membrane with a certainty of 0.7000.

NOV3 is expressed in at least the following tissues: Adrenal Gland/Suprarenal gland, Bone, Bone Marrow, Brain, Colon, Coronary Artery, Hair Follicles, Heart, Hippocampus, Kidney, Liver, Lung, Parathyroid Gland, Pituitary Gland, Prostate, Retina, Spinal Chord, Testis, Uterus and Whole Organism. This information was derived by determining the tissue sources of the sequences that were included in the invention including but not limited to SeqCalling sources, Public EST sources, Genomic Clone sources, Literature sources, and/or RACE sources. In addition, NOV3 is predicted to be expressed in the following tissues because of the expression pattern of a closely related *Mus musculus* erythroid membrane-associated protein ERMAP mRNA homolog (GENBANK-ID: gb:GENBANK-ID:AF 153906|acc:AF153906.1): Kidney, Liver and Lung.

TABLE 3B

| Encoded NOV3 protein sequence. |
|---|
| (SEQ ID NO:6) |
| MMENMVKPVNSMSMSPLPHVFSRKVSALVRGNPPSPGSAATSGFSLWVSQPPSQPWGDAGKFHVALLGGTAELLCPLSLW |
| PGTVPKEVRWLRSPFPQRSQAVHIFRDGKDQDEDLMPEYKGRTVLVRDAQEGSVTLQILDVRLEDQGSYRCLIQVGNLSK |
| EDTVILQVAAFLIRKELLVCRSVGWFPEPWAKWREPQGRVLPSLSEAHSLEKAGLFQIAVSSRVRDSTLGNVSCTIHNMA |
| LGQEKTTAVVISAPSVGSLSPSAVALAVILPVLVLLIMVCLCLIKAVAKNLIIFSELPLDNLLSDHAKEKGNDIKVGNVS |
| SFIELKRAAANSGWRRARLHFVAVTLDPDTAHPKLILSEDQRCVRLGDRRQPVPDNPQRFDFVVSILGSEYFTTGCHYWE |
| VYVGDKTKWILGVCSESVSRKGKVTASPANGHWLLRQSRGNEYEALTSPQTSFRLKEPPRCVGIFLDYEAGVISFYNVTN |
| KSHIFTFTHNFSGPLRPFFEPCLHDGGKNTAPLVICSELHKSEESIVPRPEGKGHANGDVSLKVNSSLLPPKAPELKDII |
| LSLPPDLGPALQELKAPSF |

The NOV3 amino acid sequence has 384 of 591 amino acid residues (64%) identical to, and 456 of 591 amino acid residues (77%) similar to, a *Mus musculus* 592 amino acid residue erythroid membrane-associated protein (ERMAP) (ptnr:SPTREMBL-ACC:Q9JLN5) (E 2.2e$^{-197}$).

NOV3 has homology to the amino acid sequences shown in the BLASTP data listed in Table 3C.

TABLE 3C

BLAST results for NOV3

| Gene Index/ Identifier | Protein/Organism | Length (aa) | Identity (%) | Positives (%) | Expect |
|---|---|---|---|---|---|
| gi\|7305041\|ref\|NP_038876.1\| (NM_013848) | erythroblast membrane-associated protein [*Mus musculus*] | 592 | 373/595 (62%) | 440/595 (73%) | 0.0 |
| gi\|17489129\|ref\|XP_002035.3\| (XM_002035) | erythroblast membrane-associated protein [*Homo sapiens*] | 475 | 289/360 (80%) | 301/360 (83%) | e-162 |
| gi\|15808373\|gb\|AL08411.1\| (AF311284) | erythroid membrane-associated protein [*Homo sapiens*] | 188 | 188/188 (100%) | 188/188 (100%) | e-107 |
| gi\|15079315\|gb\|AAH11497.1\|AAH11497 (BC011497) | Similar to butyrophilin, subfamily 1, member A1 [*Mus musculus*] | 524 | 209/511 (40%) | 278/511 (53%) | 1e-85 |
| gi\|7304935\|ref\|NP_038511.1\| (NM_013483) | butyrophilin [*Mus musculus*] | 524 | 209/511 (40%) | 277/511 (53%) | 2e-85 |

The homology of these sequences is shown graphically in the ClustalW analysis shown in Table 3D.

Table 3D. ClustalW Analysis of NOV3

1) NOV3 (SEQ ID NO:6)
2) gi 7305041|ref NP_038876.1| (NM_013848) erythroblast membrane-associated protein [Mus musculus] (SEQ ID NO:64)
3) gi 17489129|ref XP_002035.3| (XM_002035) erythroblast membrane-associated protein [Homo sapiens] (SEQ ID NO:65)
4) gi 15808373|gb AAL08411.1 (AF311284) erythroid membrane-associated protein [Homo sapiens] (SEQ ID NO:66)
5) gi 15079315|gb AAH11497.1 AAH11497 (BC011497) Similar to butyrophilin, subfamily 1, member A1 [Mus musculus] (SEQ ID NO:67)
6) gi 7304935|ref NP_038511.1| (NM_013483) butyrophilin [Mus musculus] (SEQ ID NO:68)

```
                     10        20        30        40        50        60        70
             ....|....|....|....|....|....|....|....|....|....|....|....|....|....|
NOV3         MMENMVKPVSSLSGSPIPHVFSRKVSALVRGNPPSPGSAATSGFSLWVSQPPSQPWGDAGKFHVALLGGT
gi|7305041|  MLKRLKKHVVAWKSCLIPH--SRKMSVHMERLSPCGSWLVGCLFTIAVFQPPVQVLGDAGKVYVAPLRDT
gi|17489129| -MEIASSAGSWLSGCLIPLVFLR-LSVHVSG--HA---------------------GDAGKFHVALLGGT
gi|15808373| ----------------------------------------------------------------------
gi|15079315| ---MAVPTNSCLLVCLLTLTVLQLPTLDSAAPFDVT---------------------APQEPVLALVGSD
gi|7304935|  ---MAVPTNSCLLVCLLTLTVLQLPTLDSAAPFDVT---------------------APQEPVLALVGSD

                     80        90       100       110       120       130       140
             ....|....|....|....|....|....|....|....|....|....|....|....|....|....|
NOV3         AELLCPLSLWPGTVPKEVRWLRSPFPQRSQAVHIFRDGKDQDEDLMPEYKGRTVLVRD-AQEGSVTLQIL
gi|7305041|  ANLPCPLFLWPNMVLSEVRWYFPGHLPRSQAVHMFRDGQDRDEDLNPESRGRTALVRD-AHKESYILQGS
gi|17489129| AELLCPLSLWPGTVPKEVRWLRSPFPQRSQAVHIFRDGKDQDEDLMPEYKGRTVLVRD-AQEGSVTLQIL
gi|15808373| ----------------------------------------------------------------------
gi|15079315| AELTCGFSPNASSEYMELLWFR---QTRSKAVLLYRDGQEQEGQQMTEYRGRATLATAGLLDGRATLLIR
gi|7304935|  AELTCGFSPNASSEYMELLWFR---QTRSTAVLLYRDGQEQEGQQMTEYRGRATLATAGLLDGRATLLIR

                    150       160       170       180       190       200       210
             ....|....|....|....|....|....|....|....|....|....|....|....|....|....|
```

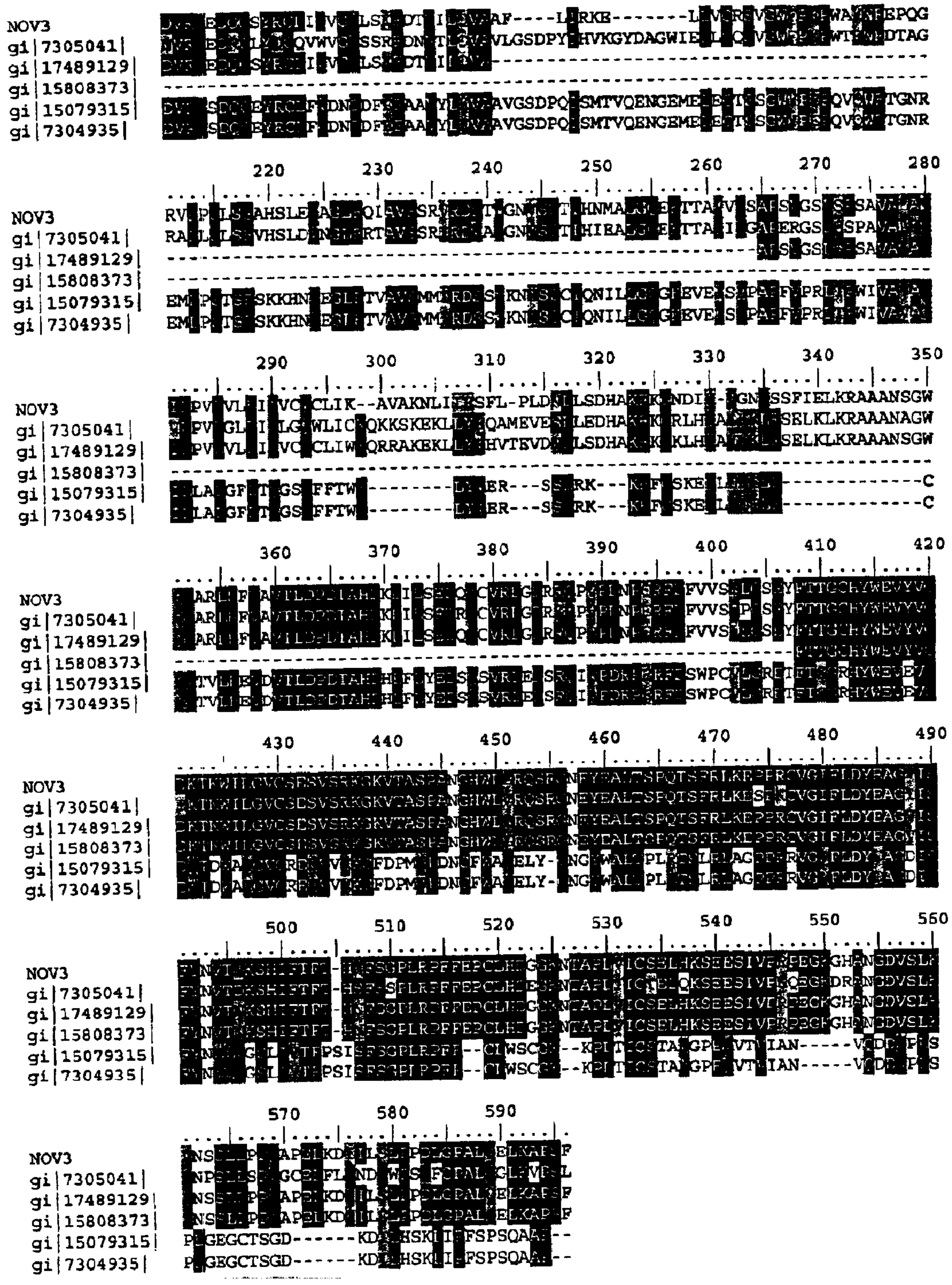
NOV3
gi|7305041|
gi|17489129|
gi|15808373|
gi|15079315|
gi|7304935|

```
NOV3            ..EE..SR..I.V.LS..T.IL.V.F----L.RKE------L.V.R..V.....WA...EPQG
gi|7305041|     .V..E..L..QVWVG.SSR.NTL.V.VLGSDPY.HVKGYDAGWIE..Q.V.....WT...DTAG
gi|17489129|    ..........I.V.LS..T.I.....----------------------------
gi|15808373|    ----------------------------------------------------
gi|15079315|    .V..S..BY.C.F.DN.DFS.AA.YL...AVGSDPQ.SMTVQENGEME...S..L.S.QV....TGNR
gi|7304935|     .V..S..BY.C.F.DN.DFS.AA.YL...AVGSDPQ.SMTVQENGEME...S..L.S.QV....TGNR

                        220       230       240       250       260       270       280
                 ....|....|....|....|....|....|....|....|....|....|....|....|....|
NOV3            RV.P.LS.AHSLE.A..QI...SR...T.GN....THNMA..E.TTA.IV.SA..GS..S.SAV.A.
gi|7305041|     RA..LS.VHSLD.N..RT.VSR.R..A.GN.S.TIHIEA.S.E.TTA.I..GA.ERGS..SPAV.A.
gi|17489129|    ----------------------------------------------------
gi|15808373|    ----------------------------------------------------
gi|15079315|    EMI.P.TS..SKKHN..EG..TVAV...MMR.S..KN.S.C.QNIL....G.EVE..S.PA.F.PR..WI.A.A
gi|7304935|     EMI.P.TS..SKKHN..EG..TVAV...MMR.S..KN.S.C.QNIL....G.EVE..S.PA.F.PR..WI.A.A

                        290       300       310       320       330       340       350
                 ....|....|....|....|....|....|....|....|....|....|....|....|....|
NOV3            ..PVV.L.I.VC..CLIK--AVAKNLI..SFL-PLD..LSDHA..K.NDI..GN.SSPIELKRAAANSGW
gi|7305041|     ..PV.VGL.I.LG..WLIC.QKKSKEKL...QAMEVE..S.LEDHA..K.RLH.A.....SELKLKRAAANAGW
gi|17489129|    ..PV.VL.I.VC..CLIW.QRRAKEKL...HVTEVD..LSDHA..K.KLH.A....SELKLKRAAANSGW
gi|15808373|    ----------------------------------------------------
gi|15079315|    ..LA.GF.T.GS.FFTW.--------..ER---SS.RK---..F.SKE..A.........-------------C
gi|7304935|     ..LA.GF.T.GS.FFTW.--------..ER---SS.RK---..F.SKE..A.........-------------C

                        360       370       380       390       400       410       420
                 ....|....|....|....|....|....|....|....|....|....|....|....|....|
NOV3            .AR..F.AV.TLD..IAH.K..I.SE..Q.CVR.G.RR..PG.I.N..E..FVVS.L.S.Y.TT.C.YWEV.YV.
gi|7305041|     .AR..F.AV.TLD..IAH.K..I.SE..Q.CVR.G.RR..PG.I.N..E..FVVS.L.S.Y.TT.C.YWEV.YV.
gi|17489129|    .AR..F.AV.TLD..IAH.K..I.SE..Q.CVR.G.RR..PG.I.N..E..FVVS.L.S.Y.T..C.YWEV.YV.
gi|15808373|    ---------------------------------------..T..C.YWEV.VY.
gi|15079315|    .TV..E..DTLD..DIAH..F.YE..S.SVR.E..S..I.FDR....SWPC..S.R.T.I.T..RHYWE.P.V.
gi|7304935|     .TV..E..DTLD..DIAH..F.YE..S.SVR.E..S..I.FDR....SWPC..S.R.T.I.T..RHYWE.P.V.

                        430       440       450       460       470       480       490
                 ....|....|....|....|....|....|....|....|....|....|....|....|....|
NOV3            .KT.WI.L.GVC.SDSVSR.KGKVTASPANGHWL..RQSR..NEYEALTSPQTSF.RLKE.PPRCVGIFLDYEAG.I.
gi|7305041|     .KT.WI.LGVC.SDSVSR.KGKVTASPANGHWL..RQSR..NEYEALTSPQTSF.RLKE.SP.CVGIFLDYEAG.I.
gi|17489129|    .KT.WI.LGVC.SDSVSR.KGKVTASPANGHWL..RQSR..NEYEALTSPQTSF.RLKE.PPRCVGIFLDYEAG.I.
gi|15808373|    .PT.WI.LGVC.SDSVSK.PGKVTASPANGHW...RQSR..NEYEALT.P.T.SF.RLKE.PPRCVGIFLDYEAG.I.
gi|15079315|    ..DA...R...V...FDPM.DN..FA.ELY-.NG.WAL.PL...L.LRAC.PD.RVC..PLDY.A.D..
gi|7304935|     ..DA...R...V...FDPM.DN..FA.ELY-.NG.WAL.PL...L.LRAC.PD.RVC..PLDY.A.D..

                        500       510       520       530       540       550       560
                 ....|....|....|....|....|....|....|....|....|....|....|....|....|
NOV3            ..NVT..SH.F.FP..-..SSGPLRPF.FEPCLH.G..NTAPL..ICSELHKSEES.IVE..PEG..GH.N.GDVSL.
gi|7305041|     .N.NVT..SH.F.FP..-..S.SGPLRPF.FEPCLH.G..NTAPL..ICSELHKSEES.IVE..PPG..GH.N.GDVSL.
gi|17489129|    .N.NVT..SH.F.FP..-..SSGPLRPF.FEPCLH.G..NTAPL..ICSELHKSEES.IVE..PPG..GH.N.GDVSL.
gi|15808373|    ..T..T.SH.F.FP..-..S.SGPLRPF.FEPCLH.G..NTAPL..ICSELHKSEES.IVE..P.G..GH.N.GDVSL.
gi|15079315|    ..NR...G..I..TEPSI.FSGPLRPE.--C.WSC...--KPIT.C.TA.GPE.VT..IAN-----V.GD..F.S
gi|7304935|     ..NR...G..I..TEPSI.FSGPLRPE.--C.WSC...--KPIT.C.TA.GPE.VT..IAN-----V.GD..F.S

                        570       580       590
                 ....|....|....|....|....|....|
NOV3            .NS..P..AP.LKD..LS..PD.GPAL.EL.KA..F
gi|7305041|     .NP..LS..GC..FL.ND.W.S..F.SPAL..CL..V..L
gi|17489129|    .NS..P..AP.LKD..LS.LP.LG.PAL.ELKAP.F
gi|15808373|    .NS..L.P..APE.LKD..LS..L.P.LG.PAL.ELKAP.F
gi|15079315|    P..GEGCTSGD------KD...HSK.I.FSPSQAA..--
gi|7304935|     P..GEGCTSGD------KD...HSK.I.FSPSQAA..--
```

Tables 3E–3H list the domain description from DOMAIN analysis results against NOV3. This indicates that the NOV3 sequence has properties similiar to those of other proteins known to contain these domains.

TABLE 3E

Domain Analysis of NOV3 gnh|Smart|smart00449, SPRY, Domain in SP1a and the RYanodine Receptor. Domain of unknown function. Distant homologues are domains in butyrophilin/marenostrin/pyrin homologues. (SEQ ID NO:69)
Length = 125 residues, 96.8% aligned
Score = 97.1 bits (240), Expect = 3e-21

```
NOV3:   395 GCHYWEVYV---GDKTKWILGVCSESVSRKGKVTASPANGH-WLLRQSRGNEYEALTSPQ  450
            | ||+|| |   |||  | +|  ++|| | |       +   |       | +|     |+
00449:    2 GRHYFEVEVFTGGDKGHWRVGWATKSVPR-GGFRLLGEDKGSWGYDGDGGKKYHNSEFPE   60

NOV3:   451 TSFRLKEPPRCVGIFLDYEAGVISFYNVTNKSHIFTFTHNFSGPLRPFFEPCLHDGGKNT  510
                 +||   +| ||| ||| ||||        +  |    ||||| |        |   +
00449:   61 YGLPFQEPGDVIGCFLDLEAGTISFYKNGKYLGLAFFDVTFSGPLYPAVSL----GNGGS  116

NOV3:   511 APLVIC                                                        516
              |
00449:  117 VRLNFG                                                        122
```

TABLE 3F

Domain Analysis of NOV3 gnl 'Pfam'pfam00622, SPRY, SPRY domain. SPRY Domain is named from SP1a and the RYanodine Receptor. Domain of unknown function. Distant homologues are domains in butyrophilin/marenostrin/pyrin homologues. (SEQ ID NO:70)
Length = 124 residues, 97.6% aligned
Score = 89.7 bits (221), Expect = 4e-19

```
NOV3:   394 TGCHYWEVYVGDK--TKWILGVCSESVSRKGKVTASPANGH-WLLRQSRGNEYEALTSPQ  450
            +| ||+|| |        | +|  ++|| ||    +     |     |     | |++|    |
00622:    1 SGKHYFEVEVDTGGEGHWRVGWATKSV-RKPGESLLGDNEGSWGFDGSGGSKYHNGTGED   59

NOV3:   451 TSFRLKEPPRCVGIFLDYEAGVISFYNVTNKSHIFTFTH-NFSGPLRPFFEPCLHDGGKN  509
                 +|     +| ||||||| |||          |+ | + +| ||| |          |
00622:   60 YGLPFQEGDV-IGCFLDYEAGEISFTKNGKDLGIYAFRNVSFGGPLYPAV----SLGSGE  114

NOV3:   510 TAPLVIC                                                       516
00622:  115 AVRFNFG                                                       121
```

TABLE 3G

Domain Analysis of NOV3 gnl Smart|smart00406, IGv, Immunoglobulin V-Type (SEQ ID NO:71)
Length = 80 residues, 97.5% aligned
Score = 49.7 bits (117), Expect = 5e-07

```
NOV3:    70 TAELLCPLSLWPGTVPKEVRWLRSPFPQRSQAVHIFRDGKDQDEDLMPEYKGRTVLVRDA  129
             +  | |  |          | |+| |          +   | |         |||| + +|
00406:    1 SVTLSCKASG-FTFSSYYVSWVRQP--PGKGLEWLGYIGSDVSYS-EASYKGRVTISKDN   56

NOV3:   130 QEGSVTLQILDVRLEDQGSYRC                                        151
             +   |+| | ++|+|| |+| |
00406:   57 SKNDVSLTISNLRVEDTGTYYC                                         78
```

TABLE 3H

Domain Analysis of NOV3 gnl Smart|smart00409, IG, Immunoglobulin (SEQ ID NO:72)
Length = 86 residues, 94.2% aligned
Score = 42.7 bits (99), Expect = 6e-05

```
NOV3:    64 VALLGGTAELLCPLSLWPGTVPKEVRWLRSPFPQRSQAVHIFRDGKDQDEDLMPEYKGRT  123
            ====[=*]==[=|]==[==]=[==][==][=|]=*=======================*====[7ca]
00409:    5 TVKEGESVTLSCEAS---GNPPPTVTWYK------------------QGGKLLAESGRF   42
```

TABLE 3H-continued

Domain Analysis of NOV3

```
NOV3:   124 VLVRDAQEGSVTLQILDVRLEDQGSYRCLIQVGNLSKEDTVILQV          168
            =*=[==]==[*=][|=][=*][==][|=][*|]=[==]===*=[==]====[=|]
00409:   43 SVSRS--GGNSTLTISNVTPEDSGTYTCAATNSSGSASSGTTLTV           85
```

The NOV3 gene sequence described herein encodes for a novel member of the Immunoglobulin superfamily of enzymes. Specifically, the sequence encodes a novel ERMAP-like protein which is related to the B7-class of immunoglobulins. B7 molecules play crucial roles in T-cell activation making them plausible targets for cancer, AIDS, and/or inflammation therapies. The protein described here may be useful in treating brain and CNS disorders; endocrine, inflammation and autoimmune disorders; pancreatic disorders and cancers including lung, pancreas, brain, and prostate.

ERMAP, a gene coding for a novel transmembrane protein produced exclusively in erythroid cells, is described. It is mapped to murine Chromosome 4, 57 cM distal to the centromere. The initial cDNA clone was isolated from a day 9 murine embryonic erythroid cell cDNA library. The predicted peptide sequence suggests that ERMAP is a transmembrane protein with two extracellular immunoglobulin folds, as well as a highly conserved B30.2 domain and several phosphorylation consensus sequences in the cytoplasmic region. ERMAP shares a high homology throughout the entire peptide with butyrophilin, a glycoprotein essential for milk lipid droplet formation and release. A GFP-ERMAP fusion protein was localized to the plasma membrane and cytoplasmic vesicles in transiently transfected 293T cells. Northern blot analysis and in-situ hybridization demonstrated that ERMAP expression was restricted to fetal and adult erythroid tissues. ERMAP is likely a novel adhesion/receptor molecule specific for erythroid cells (Ye et al., ERMAP, a gene coding for a novel erythroid specific adhesion/receptor membrane protein. Gene 242(1–2):337–45, 2000).

The above defined information for NOV3 suggests that this NOV3 protein may function as a member of a erythroid membrane-associated protein (ERMAP) protein family. Therefore, the NOV3 nucleic acids and proteins of the invention are useful in potential therapeutic and diagnostic applications. For example, a cDNA encoding the NOV3 protein may be useful in gene therapy, and the NOV3 protein may be useful when administered to a subject in need thereof. By way of nonlimiting example, the compositions of the present invention will have efficacy for treatment of patients suffering from brain disorders including epilepsy, eating disorders, schizophrenia, ADD, and cancer; heart disease; inflammation and autoimmune disorders including Crohn's disease, IBD, allergies, rheumatoid and osteoarthritis, inflammatory skin disorders, blood disorders; psoriasis colon cancer, leukemia AIDS; thalamus disorders; metabolic disorders including diabetes and obesity; lung diseases such as asthma, emphysema, cystic fibrosis, and cancer; pancreatic disorders including pancreatic insufficiency and cancer; and/or prostate disorders including prostate cancer. The NOV3 nucleic acid encoding a erythroid membrane-associated protein (ERMAP)-like protein, and the erythroid membrane-associated protein (ERMAP)-like protein of the invention, or fragments thereof, may further be useful in diagnostic applications, wherein the presence or amount of the nucleic acid or the protein are to be assessed.

NOV4

NOV4 includes two novel vitelline membrane outer layer protein I precursor (VMO-I)-like proteins disclosed below. The disclosed proteins have been named NOV4a and NOV4b.

NOV4a

A disclosed NOV4a nucleic acid of 748 nucleotides (designated CuraGen Acc. No. 133268995_da1) encoding a novel vitelline membrane outer layer protein I precursor (VMO-I)-like protein is shown in Table 4A. An open reading frame was identified beginning with an ATG initiation codon at nucleotides 63–65 and ending with a TGA codon at nucleotides 669–671. Putative untranslated regions upstream from the initiation codon and downstream from the termination codon are underlined in Table 4A, and the start and stop codons are in bold letters.

TABLE 4A

NOV4a Nucleotide Sequence (SEQ ID NO:7)

<u>CCCTCACAGAGGCCAAACTGATATAAATCTGCTTAGGAGGCCTGATTCACAGACGCTACAGG</u>ATGGAGCGGGGCGCAGG

AGCCAAGCTGCTGCCGCTGCTGCTGCTTCTGCGGGCGACTGGTTTCACATGTGCACAGACAGGTGGCCGGAACGGCTAC

ACGGCGGTCATCGAAGTGACCAGCGGGGGTCCCTGGGGCGACTGGGCCTGGCCTGAGATGTGTCCCGATGGATTCTTCG

CCAGCGGGTTCTCGCTCAAGGTGGAGCCTCCCCAAGGCATTCCTGGCGACGACACTGCACTGAATGGGATCAGGCTGCA

CTGCGCGCGCGGGAACGTCCTAGGCAATACGCACGTGGTAGAGTCCCAGTCTGGAAGCTGGGGCGAATGGAGTGAGCCG

CTGTGGTGTCGCGGCGGCGCCTACCTAGTGGCTTTCTCGCTTCGCGTGGAGGCACCCACGACCCTCGGTGACAACACAG

CAGCGAACAACGTGCGCTTCCGCTGTTCAGACGGCGAGGAACTGCAGGGGCCTGGGCTGAGTTGGGGAGACTTTGGAGA

CTGGAGTGACCATTGCCCCAAGGGCGCGTGCGGCCTGCAGACCAAGATCCAGGGACCTAGAGGCCTCGGCGATGACACT

TABLE 4A-continued

| NOV4a Nucleotide Sequence |
|---|
| GCGCTGAACGACGCGCGCTTATTCTGCTGCCGCAGT**TGA**ACGGCGCCGCCGCCGCCGCTCTCTCCCGGGCCAGGAGGCT |
| AGTCCCACCTCTTGCTATTAAAGCTTCTCTGAGTTGA |

The nucleic acid sequence of NOV4a maps to chromosome 17 and has 362 of 595 bases (60%) identical to a *Pseudomonas aeruginosa* PA01 mRNA, section 117 of 529 of the complete genome (gb:GENBANK-ID:AE004556|acc:AE004556.1) (E=0.00070).

A NOV4a polypeptide (SEQ ID NO:8) encoded by SEQ ID NO:7 is 202 amino acid residues and is presented using the one letter code in Table 4B. Signal P, Psort and/or Hydropathy results predict that NOV4a contains a signal peptide and is likely to be localized extracellularly with a certainty of 0.3700. The most likely cleavage site for a NOV4a peptide is between amino acids 24 and 25, at: TCA-QT.

TABLE 4B

| NOV4a protein sequence |
|---|
| (SEQ ID NO:8) |
| MERGAGAKLLPLLLLLRATGFTCAQTGGRNGYTAVIEVTSGGPWGDWAWPEMCPDGFFASGFSLKVEPPQGIPGDDTALNGIR |
| LHCARGNVLGNTHVVESQSGSWGEWSEPLWCRGGAYLVAFSLRVEAPTTLGDNTAANNVRFRCSDGEELQGPGLSWGDFGDWS |
| DHCPKGACGLQTKIQGPRGLGDDTALNDARLFCCRS |

The NOV4a amino acid sequence has 101 of 193 amino acid residues (52%) identical to, and 122 of 193 amino acid residues (63%) similar to, a *Gallus gallus* 183 amino acid residue vitelline membrane outer layer protein I precursor protein (VMO-I) (ptnr:SWISSPROT-ACC:P41366) (E=1.6e$^{-43}$).

NOV4a is expressed in at least the following tissues: Bone, Brain, Cervix, Duodenum, Kidney, Lung and Uterus. This information was derived by determining the tissue sources of the sequences that were included in the invention including but not limited to SeqCalling sources, Public EST sources, Genomic Clone sources, Literature sources, and/or RACE sources.

NOV4b

A disclosed NOV4b nucleic acid of 582 nucleotides (designated CuraGen Acc. No. CG56375-04) encoding a novel vitelline membrane outer layer protein I precursor (VMO-I)-like protein is shown in Table 4C. An open reading frame was identified beginning with an ATG initiation codon at nucleotides 116–118 and ending with a TGA codon at nucleotides 458–460. Putative untranslated regions upstream from the initiation codon and downstream from the termination codon are underlined in Table 4C, and the start and stop codons are in bold letters.

TABLE 4C

| NOV4b Nucleotide Sequence |
|---|
| (SEQ ID NO:9) |
| AGTGGATTAGTTTTGGGTTTCACTTAATCTGGGAGGCCCTTCCGCAATCGGAGCCCTCACAGAGGCCAAACTGTATAA |
| ATCTGCTTAGGAGGCCTGATTCACAGACGCTACAGG**ATG**GAGCGGGGCGCAGGAGCCAAGCTGCTGCCGCTGCTGCTGC |
| TTCTGCGGGCGACTGGTTTCACATGTGCACAGGCAGATGGCCGGAACGGCTACACGGCGGTCATCGAAGTGACCAGCGG |
| GGGTCCCTGGGGCGACTGGGCCTGGCCTGAGATGTGTCCCGATGGATTCTTCGCCAGCGGGTTCTCGCTCAAGGTGGAG |
| CCTCCCCAAGGCATTCCTGGCGACGACACTGCACTGAATGGGATCAGGCTGCACTGCGCGCGCGGGAACGTCCTAGGCA |
| ATACGCACGTGGTAGAGTCCCAGTCTGGAAGGTGGGGCGCAGGGGTCGAGGATCCCTTGGGG**TGA**TGTATGTCCCTTAC |
| CCTCTATTACATACTCCGTCGCAACAGGCAGGCTGGCTCCGCCAGAGCTACGGGGCAGTATAGACCGGGGAGGCGAAGG |
| GTGGATGGAAGACCCCTCCTCCGCTCCTC |

The nucleic acid sequence of NOV4b maps to chromosome 17 and has 474 of 504 bases (94%) identical to a *Homo sapiens* mRNA, Sequence 24 from Patent WO0065054 (gb:GENBANK-ID:AX041035|acc:AX041035.1) ($E=4.9e^{-92}$).

A NOV4b polypeptide (SEQ ID NO:10) encoded by SEQ ID NO:9 is 114 amino acid residues and is presented using the one letter code in Table 4D. Signal P, Psort and/or Hydropathy results predict that NOV4b contains a signal peptide and is likely to be localized extracellularly with a certainty of 0.3700. The most likely cleavage site for a NOV4b peptide is between amino acids 26 and 27, at: AQA-DG.

TABLE 4E

| SNPs | | | |
|---|---|---|---|
| Consensus Position | Depth | Base Change | PAF |
| 213 | 9 | G > A | N/A |
| 611 | 8 | T > C | N/A |

TABLE 4D

| NOV4b protein sequence |
|---|
| (SEQ ID NO:10) |
| MERGAGAKLLPLLLLLRATGFTCAQADGRNGYTAVIEVTSGGPWGDWAWPEMCPDGFFASGFSLKVEPPQGIPGDDTALNGIR |
| LHCARGNVLGNTHVVESQSGRWGAGVEDPLG |

The NOV4b amino acid sequence has 46 of 98 amino acid residues (46%) identical to, and 57 of 98 amino acid residues (58%) similar to, a *Gallus gallus* 183 amino acid residue vitelline membrane outer layer protein I precursor protein (VMO-I) (ptnr:SWISSPROT-ACC:P41366) ($E=4.4e^{-14}$).

NOV4b is expressed in at least the following tissues: Liver. This information was derived from the tissue sources of the sequences that were included in the derivation of the NOV4b sequence.

Possible small nucleotide polymorphisms (SNPs) found for NOV4a are listed in Tables 4E and 4F.

TABLE 4F

| SNPs | | | | |
|---|---|---|---|---|
| Variant | Nucleotide Position | Base Change | Amino Acid Position | Base Change |
| 13375453 | 93 | C > T | 11 | Pro > Ser |
| 13373914 | 138 | A > G | 26 | Thr > Ala |
| 13374154 | 536 | T > C | Silent | N/A |

NOV4a and NOV4b are very closely homologous as is shown in the amino acid alignment in Table 4G.

Table 4G Amino Acid Alignment of NOV4a and NOV4b

```
         10        20        30        40        50        60        70
....|....|....|....|....|....|....|....|....|....|....|....|....|....|
```

```
NOV4a  MERGAGAKLLPLLLLLRATGFTCAQTGGFNGYTAVIEVTSGGPNGDWAWPEMCPDGFFASCFSLKVEEPQ
NOV4b  MERGAGAKLLPLLLLLRATGFTCAQADGFNGYTAVIEVTSGGPNGDWAWPEMCPDGFFASCFSLKVEPPQ

                80        90        100       110       120       130       140
       ....|....|....|....|....|....|....|....|....|....|....|....|....|....|
NOV4a  GIPGDDTALNGIRLHCARGNVLCNIHVVESQSTSWCEWSEPLWCRGGAYLVAFSLRVFAPTIYGDNTAAN
NOV4b  GIPGDDTALNGIRLHCARGNVLCNIHVVESQSIRWGAG------------------VSD---LG------

                150       160       170       180       190       200
       ....|....|....|....|....|....|....|....|....|....|....|....|..
NOV4a  NVRFRCSDGEELQGPGLSWGDFGDWSDHCPKGACGLQTKIQGPRGLGDDTALNDARLFCCRS
NOV4b  --------------------------------------------------------------
```

Homologies to any of the above NOV4 proteins will be shared by the other NOV4 proteins insofar as they are homologous to each other as shown above. Any reference toNOV4 is assumed to refer to both of the NOV4 proteins in general, unless otherwise noted.

NOV4a also has homology to the amino acid sequences shown in the BLASTP data listed in Table 4H.

```
NOV4a  MERGAGAKLLPLLLLLRATGFTCAQTGGFNGYTAVIEVTSGGPWGDWAWPEMCPDGFFASGFSLKVEEPQ
NOV4b  MERGAGAKLLPLLLLLRATGFTCAQADGFNGYTAVIEVTSGGPWGDWAWPEMCPDGFFASGFSLKVEEPQ

                 80        90        100       110       120       130       140
       ....|....|....|....|....|....|....|....|....|....|....|....|....|....|
NOV4a  GIPGDDTALNGIRLHCARGNVLGNIHVVLSQSTSWCEWSEPLWCRGGAYLVAFSLRVFAPTTYGDNTAAN
NOV4b  GIPGDDTALNGIRLHCARGNVIGNIHVVESQSIRWCAG-----------------VFD---LG-------

                 150       160       170       180       190       200
       ....|....|....|....|....|....|....|....|....|....|....|....|..
NOV4a  NVRFRCSDGEELQGPGLSWGDFGDWSDHCPKGACGLQTKIQGPRGLGDDTALNDARLFCCRS
NOV4b  --------------------------------------------------------------
```

Table 4I ClustalW Analysis of NOV4a

1) NOV4a (SEQ ID NO:8)
2) gi 17491218|ref XP_058875.1| (XM_058875) similar to VITELLINE MEMBRANE OUTER LAYER PROTEIN I PRECURSOR (VMO-I) (VMOI) (H. sapiens) [Homo sapiens] (SEQ ID NO:73)
3) gi 1174974|sp P41366 VMO1_CHICK VITELLINE MEMBRANE OUTER LAYER PROTEIN I PRECURSOR (VMO-I) (VMOI) [Gallus gallus] (SEQ ID NO:74)
4) gi 576329|pdb 1VMO|A Chain A, Vitelline Membrane Outer Layer Protein I [Gallus gallus] (SEQ ID

TABLE 4H

BLAST results for NOV4

| Gene Index/ Identifier | Protein/Organism | Length (aa) | Identity (%) | Positives (%) | Expect |
|---|---|---|---|---|---|
| gi\|17491218\|ref\|XP_058875.1\| (XM_058875) | similar to VITELLINE MEMBRANE OUTER LAYER PROTEIN I PRECURSOR (VMO-I) (VMOI) (*H. sapiens*) [*Homo sapiens*] | 109 | 92/92 (100%) | 92/92 (100%) | 2e−44 |
| gi\|1174974\|sp\|P41366\|VMO1_CHICK | VITELLINE MEMBRANE OUTER LAYER PROTEIN I PRECURSOR (VMO-I) (VMOI) [*Gallus gallus*] | 183 | 87/170 (51%) | 106/170 (62%) | 4e−35 |
| gi\|576329\|pdb\|1VMO\|A | Chain A, Vitelline Membrane Outer Layer Protein I [*Gallus gallus*] | 163 | 87/170 (51%) | 106/170 (62%) | 7e−34 |
| gi\|4567054\|gb\|AAD23572.1\|AF123591_1 (AF123591) | fertilization envelope outer layer protein [*Cyprinus carpio*] | 200 | 83/174 (47%) | 104/174 (59%) | 2e−32 |
| gi\|17542904\|ref\|NP_500684.1\| (NM_068283) | Y9C9A.1.p [*Caenorhabditis elegans*] | 360 | 60/175 (34%) | 85/175 (48%) | 2e−18 |

The homology of these sequences is shown graphically in the ClustalW analysis shown in Table 4I.

Table 4I ClustalW Analysis of NOV4a

1) NOV4a (SEQ ID NO:8)
2) gi 17491218|ref XP_058875.1| (XM_058875) similar to VITELLINE MEMBRANE OUTER LAYER PROTEIN I PRECURSOR (VMO-I) (VMOI) (H. sapiens) [Homo sapiens] (SEQ ID NO:73)
3) gi 1174974|sp P41366 VMO1_CHICK VITELLINE MEMBRANE OUTER LAYER PROTEIN I PRECURSOR (VMO-I) (VMOI) [Gallus gallus] (SEQ ID NO:74)
4) gi 576329|pdb 1VMO|A Chain A, Vitelline Membrane Outer Layer Protein I [Gallus gallus] (SEQ ID NO:75)
5) gi 4567054|gb AAD23572.1|AF123591_1 (AF123591) fertilization envelope outer layer protein [Cyprinus carpio] (SEQ ID NO:76)
6) gi 17542904|ref NP_500684.1| (NM_068283) Y9C9A.1.p [Caenorhabditis elegans] (SEQ ID NO:77)
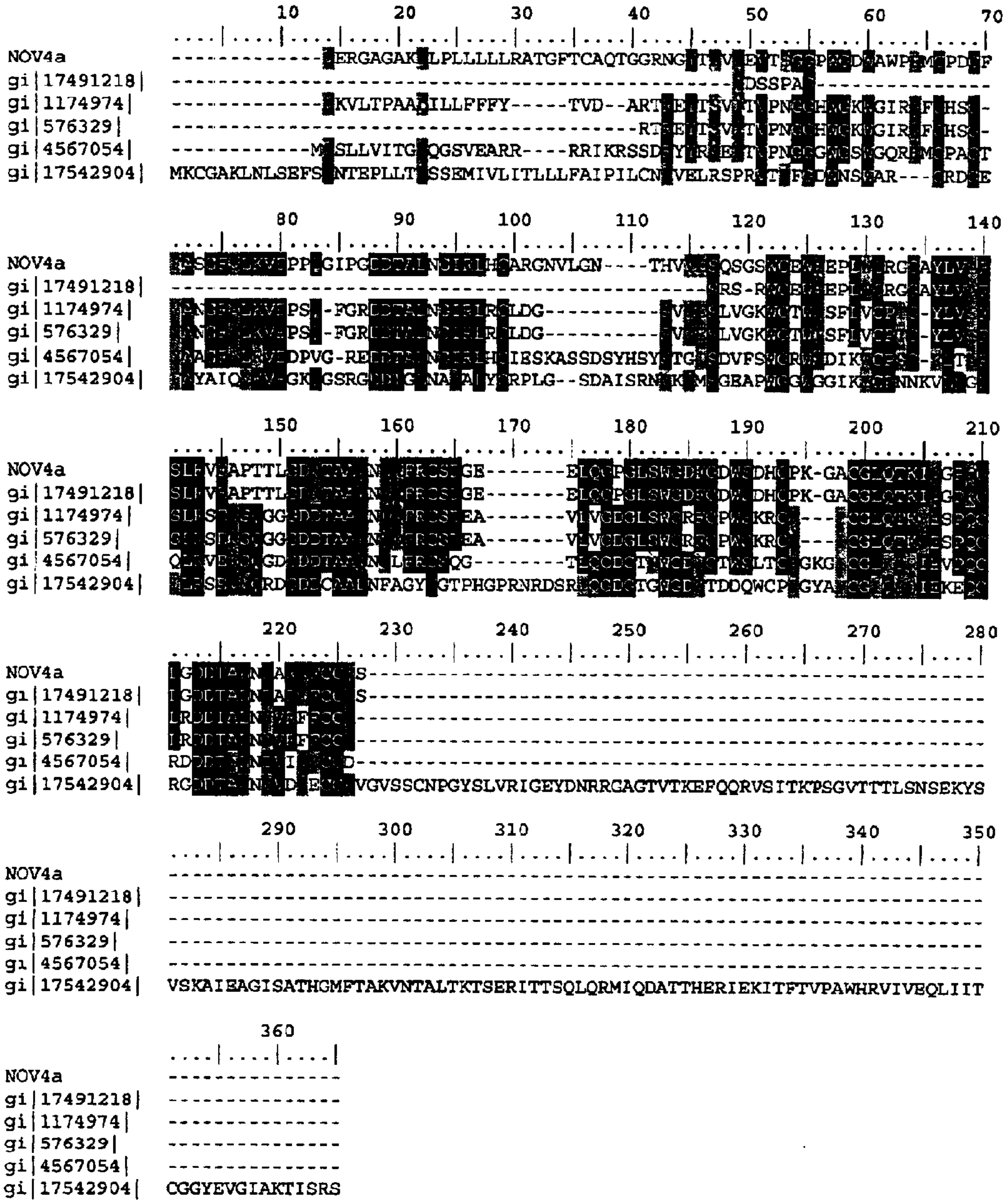

The cloning and sequencing of hen magnum cDNAs encoding vitelline membrane outer layer protein I (VMO-I) was first published on Gene 144 (2), 311–312 (1994). On May 18, 1994 this sequence version replaced gi:439481 submitted (Dec. 6, 1993) to DDBJ. Two cDNAs encoding hen vitelline membrane outer layer protein I (VMO-I), which is classified as a new type of multi-beta-sheet assembly, were cloned and sequenced. Northern blot analysis using vmo-I cDNA as a probe showed the presence of three mRNA species. Strikingly, expression of these mRNAs was restricted to a specific region of the hen oviduct, the area joining the infundibulum to the magnum. The crystal structure of vitelline membrane outer layer protein I (VMO-I), which is isolated from the vitelline membrane outer layer of hen's eggs, has been determined by the multiple isomorphous replacement method and refined to an R-factor of 18.8% at 2.2 A resolution. The main chain folds into an unusual structure that consists of three beta-sheets forming Greek key motifs, which are related by an internal pseudo three-fold symmetry. The internal portion surrounded by these three beta-sheets is filled with hydrophobic side chains. This conformational feature coincides with three internal repeats in the sequence. This new protein fold with internal symmetry has been observed in two proteins: vitelline membrane outer layer protein I (VMO-I) and delta-endotoxin. Despite lacking any discernible sequence similarity, both proteins have similar three-dimensional structures as well as a carbohydrate-binding site in the top region of the common fold. Although a similar fold exists in the second domain of delta-endotoxin, there are significant structural differences between the two proteins, with the three-fold symmetry being most regular in VMO-I. Even though the exact function is not known, component of the outer membrane of the vitelline layer of the egg seems to be able to synthesize N-acetylchito-oligosaccharides (N=14–15) from hexaxaccharides of N-acetylglusosamine in a manner similar to the transferase activity of lysozyme.

A component of the outer membrane of the vitelline layer of the egg which is able to synthesize n-acetylchito-oligosaccharides (n=14–15) from hexasaccharides of n-acetylglucosamine in a manner similar to the transferase activity of lysozyme (SWISSPROT-ACC:P41366).

Lysozyme catalyzes the hydrolysis of certain mucopolysaccharides of bacterial cell walls. Specifically, it catalyzes the hydrolysis of the bacterial cell wall beta(1–4) glycosidic linkages between N-acetylmuramic acid and N-acetylglucosamine. It is found in spleen, lung, kidney, white blood cells, plasma, saliva, milk and tears. Alexander Fleming (1881–1955), of penicillin fame, discovered and named lysozyme. In a communication to the Royal Society, Fleming (Proc. Roy. Soc. Ser. B. 93: 306–317, 1922) wrote: ' . . . I wish to draw attention to a substance present in the tissues and secretions of the body, which is capable of rapidly dissolving certain bacteria. As this substance has properties akin to those of ferments I have called it a Lysozyme . . . ' Fleming and Allison (Brit. J. Exp. Path. 3: 252–260, 1922) demonstrated an unusually high concentration in cartilage, indeed the highest of any tissue. Its role in cartilage is unknown. It resembles lactalbumin in structure. Human lysozyme has a molecular mass of 14,602 Da. Neufeld (Personal Communication. Bethesda, Md., 1972) suggested that a genetic defect of lysozyme might underlie a skeletal dysplasia. Spitznagel et al. (J. Clin. Invest. 51: 93A only, 1972) observed a patient with selective deficiency of a particular type of neutrophil granule which resulted in about 50% reduction in lysozyme levels. The patient showed increased susceptibility to infection.

Prieur et al. (Am. J. Path. 77: 283–296,1974) described inherited lysozyme deficiency in rabbits. No abnormality of cartilage or bone was noted (Greenwald et al., Biochim. Biophys. Acta 385: 435–437,1975). Older mutant rabbits showed increased susceptibility to infections, especially subcutaneous abscesses (Personal Communication. Pullman, Wash., May 13, 1975.). Camara et al. (Lab. Invest. 63: 544–550,1990) identified 2 isozymes of rabbit lysozyme and showed that their distribution was tissue specific. Leukocytic and gastrointestinal isozymes were clearly distinguished, and a possible lymphoepithelial isozyme that resembled the gastrointestinal isozyme electrophoretically and chromatographically but not kinetically was demonstrated. Mutant, lysozyme-deficient rabbits completely lacked a detectable leukocytic isozyme but had gastrointestinal and lymphoepithelial isozymes indistinguishable from those of normal rabbits. By electrophoretic methods, the mutant rabbits were shown to lack a protein band corresponding to that of the leukocytic isozyme in normal rabbits.

Yoshimura et al. (Biochem. Biophys. Res. Commun. 150:794–801,1988) isolated a cDNA encoding human lysozyme from a human placenta cDNA library. The 1.5-kb cDNA coded for a signal peptide consisting of 18 amino acids and for mature lysozyme. The amino acid sequence of the mature lysozyme, deduced from the nucleotide sequence, was identical with the published sequence. Human lysozyme has 130 amino acid residues and 4 disulfide bonds (Taniyama et al., J. Biol. Chem. 266: 6456–6461, 1991). Peters et al. (Cytogenet. Cell Genet. 51: 1059,1989) described the isolation of 2 overlapping genomic clones containing 25 kb of the human lysozyme gene region. They also isolated a full-length human lysozyme cDNA clone from a human placental cDNA library. They reported on the nucleotide sequence of the entire structural gene and the cDNA clone. Using a panel of somatic cell hybrids, Peters et al. (Biochemistry 38: 6419–6427,1989) assigned the lysozyme gene to human chromosome 12.

Canet et al. (Biochemistry 38(20):6419–27, 1999) studied the unfolding and refolding properties of human lysozyme and 2 of its amyloidogenic variants, ile56 to thr and asp67 to his, by stopped-flow fluorescence and hydrogen exchange pulse labeling coupled with mass spectrometry. Their results suggested that the amyloidogenic nature of the lysozyme variants arises from a decrease in the stability of the native fold relative to partially folded intermediates. The origin of this instability was different in the 2 variants, being caused in one case primarily by a reduction in the folding rate and in the other by an increase in the unfolding rate. In both cases, this resulted in a low population of soluble partially folded species that can aggregate in a slow and controlled manner to form amyloid fibrils. In the human, mutations in the LYZ gene in renal amyloidosis represented the first link of lysozyme to genetic disease (153450.0001).

The above defined information for NOV4 suggests that this NOV4 protein may function as a member of a vitelline membrane outer layer protein I precursor (VMO-I) protein family. Therefore, the NOV4 nucleic acids and proteins of the invention are useful in potential therapeutic and diagnostic applications. For example, a cDNA encoding the NOV4 protein may be useful in gene therapy, and the NOV4 protein may be useful when administered to a subject in need thereof. By way of nonlimiting example, the compositions of the present invention will have efficacy for treatment of patients suffering from osteoporosis, hypercalceimia, arthritis, ankylosing spondylitis, scoliosis, neurological disorders and diseases, systemic lupus erythematosus, autoimmune disease, asthma, emphysema, scleroderma, allergy, ARDS, diabetes, renal artery stenosis, interstitial nephritis, glomerulonephritis, polycystic kidney disease, renal tubular acidosis, IgA nephropathy, hypercalceimia, Lesch-Nyhan syndrome, Von Hippel-Lindau (VHL) syndrome, cirrhosis and/or transplantation. The NOV4 nucleic acid encoding vitelline membrane outer layer protein I precursor (VMO-I)-like protein, and the vitelline membrane outer layer protein I precursor (VMO-I)-like protein of the invention, or fragments thereof, may further be useful in diagnostic applications, wherein the presence or amount of the nucleic acid or the protein are to be assessed.

NOV5

A disclosed NOV5 nucleic acid of 7676 nucleotides (also referred to as CG56089-01) encoding a novel MAST205-like protein is shown in Table 5A. An open reading frame was identified beginning with an ATG initiation codon at nucleotides 25–27 and ending with a TAA codon at nucleotides 7660–7662. Putative untranslated regions upstream from the intitation codon and downstream from the termination codon are underlined in Table 5A, and the start and stop codons are in bold letters.

TABLE 5A

| NOV5 Nucleotide Sequence |
|---|
| (SEQ ID NO:11) |
| GAAACTGGTTTTCACAGGTGATAGATGGAAGGCTGTTTTCAAAAGATCAAGCTTGACCACATATTATCCCCTCCACCCATGC |
| CGTTTCGGAAATGCAGCAACCCAGATGTGGCTTCTGGCCCTGGAAAATCACTGAAGTATAAAAGACAGCTGAGTGAGGATGG |
| AAGACAGCTAAGGCGAGGGAGCCTGGGAGGAGCCCTGACTGGGAGGTACCTTCTTCCAAACCCGGTGGCGGGACAGGCCTGG |
| CCGGCCTCTGCAGAGACGTCCAACCTCGTGCGCATGCGCAGCCAGGCCCTGGGCCAGTCGGCGCCCTCGCTCACCGCCAGCC |
| TGAAGGAGCTGAGTCTCCCCAGAAGAGGAAGTTTTCTCACTCCCAGGAGCCTGAGTCCAACCCCATCCAGCCCAGGCAGTCC |
| TTGTAGTCCTCTCTTGGCCTTTCACTTTTGGAGCCCTGTGTGTCCAAATGCTGGGTGCCGAACAAGCAACCGGAAAAGCTTA |
| ATAGGCAATGGGCAGTCACCAGCATTGCCTCGACCACACTCACCTCTCTCTGCTCATGCAGGAAATAGCCCTCAAGATAGTC |
| CAAGAAATTTCTCCCCCAGTGCCTCAGCCCATTTTTCATTTGCACGGAGGACTGATGGACGCCGCTGGTCGTTGGCTTCTCT |
| CCCTTCCTCTGGCTATGGGACAAACACACCCAGCTCTACGGTCTCTTCATCCTGTTCCTCCCAGGAGAAGTTGCATCAGTTA |
| CCATACCAACCAACACCAGACGAGTTACACTTCTTATCAAAACATTTCTGTACCACCGAAAGCATCGCCACTGAGAACAGAT |
| GCAGGAACACGCCGATGCGCCCCCGTTCCCGAAGTCTGAGCCCTGGACGTTCTCCCGCCTGCTGTGACCATGAAATAATTAT |
| GATGAACCATGTCTACAAAGAAAGGTTCCCAAAGGCTACAGCTCAGATGGAAGAACGTCTAAAGGAAATTATCACCAGCTAC |
| TCTCCTGACAACGTTCTACCCTTAGCAGATGGAGTGCTTAGTTTCACTCACCACCAGATTATTGAACTGGCTCGAGATTGCT |
| TGGATAAATCCCACCAGGGCCTCATCACCTCACGATACTTCCTTGAATTACAGCACAAATTAGATAAGTTGCTACAGGAGGC |
| TCATGATCGTTCAGAAAGTGGAGAATTGGCATTTATTAAACAACTAGTTCGAAAGATCCTAATTGTTATTGCCCGCCCTGCT |
| CGGTTATTAGAGTGCCTGGAATTTGATCCGGAAGAATTTTACTACCTATTGGAAGCAGCAGAAGGCCATGCCAAAGAAGGAC |
| AGGGTATTAAAACCGACATTCCCAGGTACATCATTAGCCAACTGGGACTCAATAAGGATCCCTTGGAAGAAATGGCTCATTT |
| GGGAAACTACGATAGTGGGACAGCAGAAACACCAGAAACAGATGAATCAGTGAGTAGCTCTAATGCCTCCCTGAAACTTCGA |
| AGGAAACCTCGGGAAAGTGATTTTGAAACGATTAAATTGATTAGCAATGGAGCCTATCGGGCAGTCTACTTTGTTCGGCATA |
| AAGAATCCCGGCAGAGGTTTGCCATGAAGAAGATTAATAAACAGAACCTCATCCTTCGAAACCAGATCCAGCAGGCCTTTGT |
| GGAGCGGGATATCCTGACTTTTGCAGAAAACCCCTTTGTTGTCAGCATGTATTGCTCCTTTGAAACAAGGCGCCACTTGTGC |
| ATGGTCATGGAATATGTGGAAGGGGGAGACTGTGCTACTTTAATGAAAAACATGGGTCCTCTCCCTGTTGATATGGCCAGAA |
| TGTACTTTGCTGAGACGGTCTTGGCCTTGGAATATTTACATAATTATGGAATTGTACACAGGGATTTGAAACCAGACAGCTT |
| GTTGGTTACCTCCATGGGGCACATAAAGCTGACAGATTTTGGATTATCTAAGGTGGGACTAATGAGCATGACTACCAACCTT |
| TACGAGGGTCATATTGAGAAGGATGCTAGAGAGTTCCTGGATAAACAGGTCTGTGGCACACCTGAATACATTGCACCAGAAG |
| TGATTCTGAGGCAGGGTTATGGAAAGCCGGTGGACTGGTGGGCCATGGGGATTATCCTCTATGAATTTCTGGTTGGATGCGT |
| GCCATTCTTTGGGGATACTCCAGAGGAGCTATTTGGACAAGTCATCAGTGATGAGATCAACTGGCCTGACAACGATGAGGCA |
| CCCCCACCTGATGCCCAGGATCTGATTACCTTACTCCTCAGGCAGAATCCCCTGGAGAGGCTGGCAACAGGTGGTGCATATG |
| AAGTCAAACAGCATCGATTCTTCCGTTCTTTAGACTGGAACAGTTTGCTGAGACAGAAGGCAGAATTTATTCCCCAACTGGA |
| ATCTGAGGATGACACAAGTTATTTTGATACTCGGTCTGAGAAGTATCATCATATGGAAACGGAGGAAGAAGATGACACAAAT |
| GATGAAGACTTTAATGTGGAAATAAGGCAGTTTTCTTCATGTTCACACAGGTTTTCAAAAGTTTTCAGCAGTATAGATCGAA |

TABLE 5A-continued

| NOV5 Nucleotide Sequence |
|---|
| TCACTCACAATTCACCAGAAGAGAAGGAAGACTCTGTGGACAAAACCAAAAGCACCACCTTGCCATCCACAGAAACACTGAG |
| CTGGAGTTCAGAATATTCTGAAATGCAACAGCTATCAACATCCAACTCTTCAGATACTGAAAGCAACAGACATAAACTCAGT |
| TCTGGCCTACTTCCCAAACTGGCTATTTCAACAGAGGGAGAGCAAGATGAAGCTGCCTCCTGCCCTGGAGACCCCCATGAGG |
| AGCCAGGAAAGCCAGCCCTTCCTCCTGAAGAGTGTGCCCAGGAGGAGCCTGAGGTCACCACCCCAGCCAGCACCATCAGCAG |
| CTCCACCCTGTCAGTTGGCAGTTTTTCAGAGCACTTGGATCAGATAAATGGACGAAGCGAGTGTGTGGACAGTACAGATAAT |
| TCCTCAAAGCCATCCAGTGAACCCGCTTCTCACATGGCTCGGCAGCGATTAGAAAGCACAGAAAAAAAGAAAATCTCGGGGA |
| AAGTCACAAAGTCCCTCTCTGCCAGTGCTCTTTCCCTCATGATCCCAGGAGATATGTTTGCTGTTTCCCCTCTGGGAAGTCC |
| AATGTCTCCCCATTCCCTGTCCTCGGACCCTTCTTCTTCACGAGATTCCTCTCCCAGCCGAGATTCCTCAGCAGCTTCTGCC |
| AGTCCACATCAGCCGATTGTGATCCACAGTTCGGGGAAGAACTACGGCTTTACCATCCGAGCCATCCGGGTGTATGTGGGAG |
| ACAGTGACATCTATACAGTGCACCATATCGTCTGGAATGTAGAAGAAGGAAGTCCCGCATGCCAGGCAGGACTGAAGGCTGG |
| AGATCTTATCACTCACATCAATGGAGAACCACTGCATGGACTTGTCCACACAGAAGTTATAGAACTCCTACTGAAGAGTGGG |
| AATAAGGTGTCAATCACTACTACCCCATTTGAAAACACATCAATCAAAACTGGACCAGCCAGGAGAAACAGCTATAAGAGCC |
| GGATGGTGAGGCGGAGCAAGAAATCCAAGAAGAAAGAAAGTCTCGAAAGGAGCAGATCTCTTTTCAAAAAGCTAGCCAAGCA |
| GCCTTCTCCTTTACTCCACACCAGCCGAAGTTTCTCCTGCTTGAACAGATCCCTGTCATCGGGTGAGAGCCTCCCAGGTTCC |
| CCCACTCATAGCTTGTCTCCCCGGTCTCCAACACCAAGCTACCGCTCCACCCCTGACTTCCCATCTGGTACTAATTCCTCCC |
| AGAGCAGCTCCCCTAGTTCTAGTGCCCCCAATTCCCCAGCAGGGTCCGGGCACATCCCGCCCAGCACTCTCCACGGTCTTGC |
| ACCCAAACTCGGCGGGCAGCGGTACCGGTCCGGAAGGCGAAAGTCCGCCGGCAACATCCCACTGTCCCCGCTGGCCCGGACG |
| CCCTCTCCAACCCCGCAACCCACCTCCCCGCAGCGGTCACCATCCCCTCTTCTGGGACACTCACTGGGCAATTCCAAGATCG |
| CGCAAGCCTTTCCCAGCAAGATGCACTCCCCGCCCACCATCGTCAGACACATCGTGAGGCCCAAGAGTGCGGACCCCCCCAG |
| GTCCCCGCTGCTCAAGCGCGTGCAGTCCGAGGAGAAGCTGTCGCCCTCTTACGGCAGTGACAAGAAGCACCTGTGCTCCCGC |
| AAGCACAGCCTGGAGGTGACCCAAGAGGAGGTGCAGCGGGAGCAGTCCCAGCGGGAGGCGCCGCTGCAGAGCCTGGATGAGA |
| ACGTGTGCGACGTGCCGCCGCTCAGCCGCGCCCGGCCAGTGGAGCAAGGCTGCCTGAAACGCCCAGTCTCCCGGAAGGTGGG |
| CCGCCAGGAGTCTGTGGACGACCTGGACCGCGACAAGCTGAAGGCCAAGGTGGTGGTGAAGAAAGCAGACGGCTTCCCAGAG |
| AAACAGGAATCCCACCAGAAATCCCATCCACCCGGGAGTGATTTGGAAAACTTTGCTCTGTTTAAGCTGGAAGAGAGAGAGA |
| AGAAAGTCTATCCGAAGGCTGTGGAAAGGTCAAGTACTTTTGAAAACAAAGCGTCTATGCAGGAGGCGCCACCGCTGGGCAG |
| CCTGCTGAAGGATGCTCTTCACAAGCAGGCCAGCGTGCGCGCCAGCGAGGGTGCGATGTCGGATGGCCCGGTGCCTGCGGAG |
| CACCGCCAGGGTGGCGGGGACTTCAGACGGGCCCCCGCTCCTGGCACCCTCCAGGATGGTCTCTGCCACTCCCTCGACAGGG |
| GCATCTCTGGGAAGGGGGAAGGCACGGAGAAGTCCTCCCAGGCCAAGGAGCTTCTCCGATGTGAAAAGTTAGACAGCAAGCT |
| GGCCAACATCGATTACCTCCGAAAGAAAATGTCACTTGAGGACAAAGAGGACAACCTCTGCCCTGTGCTGAAGCCCAAGATG |
| ACAGCTGGCTCCCACGAATGCCTGCCAGGGAACCCAGTCCGACCCACGGGTGGGCAGCAGGAGCCCCCGCCGGCTTCTGAGA |
| GCCGAGCTTTTGTCAGCAGCACCCATGCAGCTCAGATGAGTGCCGTCTCTTTTGTTCCCCTCAAGGCCTTAACAGGCCGGGT |
| GGACAGTGGAACGGAGAAGCCTGGCTTGGTTGCTCCTGAGTCCCCTGTTAGGAAGAGCCCCTCCGAGTATAAGCTGGAAGGT |
| AGGTCTGTCTCATGCCTGGAGCCGATGGAGGGCACTCTGGACATTGCTCTCCTGTCCGGACCTCAGGCCTCCAAGACAGAAC |
| TGCCTTCCCCAGAGTCTGCACAGAGCCCCAGCCCAAGTGGTGACGTGAGGGCCTCTGTGCCACCAGTTCTCCCCAGCAGCAG |
| TGGGAAAAAGAACGATACCACCAGTGCAAGAGAGCTTTCTCCTTCCAGCTTAAACATGAATAAATCCTACCTGCTGGAGCCT |
| TGGTTCCTGCCCCCCAGCCGAGGTCTCCAGAATTCACCAGCAGTTTCCCTGCCTGACCCAGAGTTCAAGAGGGACAGGAAAG |
| GTCCCCATCCTACTGCCAGGAGCCCTGGAACAGTCATGGAAAGCAATCCCCAACAGAGAGAGGGCAGCTCCCCTAAACACCA |
| AGACCACACCACTGACCCCAAGCTTCTGACCTGCCTGGGGCAGAACCTCCACAGCCCTGACCTGGCCAGGCOACGCTGCCCG |

TABLE 5A-continued

| NOV5 Nucleotide Sequence |
|---|
| CTCCCACCTGAAGCTTCCCCCTCAAGGGAGAAGCCAGGCCTGAGGGAATCGTCTGAAAGAGGCCCTCCCACAGCCAGAAGCG |
| AGCGCTCTGCTGCGAGGGCTGACACATGCAGAGAGCCCTCCATGGAACTGTGCTTTCCAGAAACTGCGAAAACCAGTGACAA |
| CTCCAAAAATCTCCTCTCTGTGGGAAGGACCCACCCAGATTTCTATACACAGACCCAGGCCATGGAGAAAGCATGGGCGCCG |
| GGTGGGAAAACGAACCACAAAGATGGCCCAGGTGAGGCGAGGCCCCCGCCCACAGACAACTCCTCTCTGCACTCAGCTGGAA |
| TTCCCTGTGAGAAGGAGCTGGGCAAGGTGAGGCGTGGCGTGGAACCCAAGCCCGAAGCGCTTCTTGCCAGGCGGTCTCTGCA |
| GCCACCTGGAATTGAGAGTGAGAAGAGTGAAAAGCTCTCCAGTTTCCCATCTTTGCAGAAAGATGGTGCCAAGGAACCTGAA |
| AGGAAGGAGCAGCCTCTACAAAGGCATCCCAGCAGCATCCCTCCGCCCCCTCTGACGGCCAAAGACCTGTCCAGCCCGGCTG |
| CCAGGCAGCATTGCAGTTCCCCAAGCCACGCTTCTGGCAGAGAGCCGGGGGCCAAGCCCAGCACTGCAGAGCCCAGCTCGAG |
| CCCCCAGGACCCTCCCAAGCCTGTTGCTGCGCACAGTGAAAGCAGCAGCCACAAGCCCCGGCCTGGCCCTGACCCGGGCCCT |
| CCAAAGACTAAGCACCCCGACCGGTCCCTCTCCTCTCAGAAACCAAGTGTCGGGGCCACAAAGGGCAAAGAGCCTGCCACTC |
| AGTCCCTCGGTGGCTCTAGCAGAGAGGGGAAGGGCCACAGTAAGAGTGGGCCGGATGTGTTTCCTGCTACCCCAGGCTCCCA |
| GAACAAAGCCAGCGATGGGATTGGCCAGGGAGAAGGTGGGCCCTCTGTCCCACTGCACACTGACAGGGCTCCTCTAGACGCC |
| AAGCCACAACCCACCAGTGGTGGGCGGCCCCTGGAGGTGCTGGAGAAGCCTGTGCATTTGCCAAGGCCGGGACACCCAGGGC |
| CTAGTGAGCCAGCGGACCAGAAACTGTCCGCTGTTGGTGAAAAGCAAACCCTGTCTCCAAAGCACCCCAAACCATCCACTGT |
| GAAAGATTGCCCCACCCTGTGCAAACAGACAGACAACAGACAGACAGACAAAAGCCCGAGTCAGCCGGCCGCCAACACCGAC |
| AGAAGGGCGGAAGGGAAGAAATGCACTGAAGCACTTTATGCTCCAGCAGAGGGCGACAAGCTCGAGGCCGGCCTTTCCTTTG |
| TGCATAGCGAGAACCGGTTGAAAGGCGCGGAGCGGCCAGCCGCGGGGGTGGGGAAGGGCTTCCCTGAGGCCAGAGGGAAAGG |
| GCCCGGTCCCCAGAAGCCACCGACGGAGGCAGACAAGCCCAATGGCATGAAACGGTCCCCCTCAGCCACTGGGCAGAGTTCT |
| TTCCGATCCACGGCCCTCCCGGAAAAGTCTCTGAGCTGCTCCTCCAGCTTCCCTGAAACCAGGGCCGGAGTTAGAGAGGCCT |
| CTGCAGCCAGCAGCGACACCTCTTCTGCCAAGGCCGCCGGGGGCATGCTGGAGCTTCCAGCCCCCAGCAACAGGGACCATAG |
| GAAGGCTCAGCCTGCCGGGGAGGGCCGAACCCACATGACAAAGAGTGACTCCCTGCCCTCCTTCCGGGTCTCCACCCTGCCT |
| CTGGAGTCACACCACCCCGACCCAAACACCATGGGCGGGGCCAGCCACCGGGACAGGGCTCTCTCGGTGACTGCCACCGTAG |
| GGGAAACCAAAGGGAAGGACCCTGCCCCAGCCCAGCCTCCCCCAGCTAGGAAACAGAACGTGGGCAGAGACGTGACCAAGCC |
| ATCCCCAGCCCCAAACACTGACCGCCCCATCTCTCTTTCTAATGAGAAGGACTTTGTGGTACGGCAGAGGCGGGGGAAAGAG |
| AGTTTGCGTAGCAGCCCTCACAAAAAGGCCTTG**TAA**<u>CGGGGAGGGCCCAG</u> |

The NOV5 nucleic acid was identified on chromosome 5 and has 1549 of 2075 bases (74%) identical to a *Mus musculus* MAST205 protein kinase mRNA (gb:GENBANK-ID:MMU02313|acc:U02313.1) (E=$2.3e^{-307}$).

A disclosed NOV5 polypeptide (SEQ ID NO:12) encoded by SEQ ID NO:11 is 2545 amino acid residues and is presented using the one-letter code in Table 5B. Signal P, Psort and/or Hydropathy results predict that NOV5 does not contain a signal peptide and is likely to be localized to the nucleus with a certainty of 0.9000 and to the golgi body with a certainty of 0.9000.

TABLE 5B

| Encoded NOV5 protein sequence |
|---|
| (SEQ ID NO:12) |
| MEGCFQKIKLDHILSPPPMPFRKCSNPDVASGPGKSLKYKRQLSEDGRQLRRGSLGGALTGRYLLPNPVAGQAWPASAETS |
| NLVRMRSQALGQSAPSLTASLKELSLPRRGSFLTPRSLSPTPSSPGSPCSPLLAFHFWSPVCPNAGCRTSNRKSLIGNGQS |
| PALPRPHSPLSAHAGNSPQDSPRNFSPSASAHFSFARRTDGRRWSLASLPSSGYGTNTPSSTVSSSCSSQEKLHQLPYQPT |
| PDELHFLSKHFCTTESIATENRCRNTPMRPRSRSLSPGRSPACCDHEIIMMNHVYKERFPKATAQMEERLKEIITSYSPDN |
| VLPLADGVLSFTHHQIIELARDCLDKSHQGLITSRYFLELQHKLDKLLQEAHDRSESGELAFIKQLVRKILIVTARPARLL |

TABLE 5B-continued

| Encoded NOV5 protein sequence |
|---|
| ECLEFDPEEFYYLLEAAEGHAKEGQGIKTDIPRYIISQLGLNKDPLEEMAHLGNYDSGTAETPETDESVSSSNASLKLRRK |
| PRESDFETIKLISNGAYGAVYFVRHKESRQRFAMKKINKQNLILRNQIQQAFVERDILTFAENPFVVSMYCSFETRRHLCM |
| VMEYVEGGDCATLMKNMGPLPVDMARMYFAETVLALEYLHNYGIVHRDLKPDSLLVTSMGHIKLTDFGLSKVGLMSMTTNL |
| YEGHIEKDAREFLDKQVCGTPEYIAPEVILRQGYGKPVDWWAMGIILYEFLVGCVPFFGDTPEELFGQVISDEINWPEKDE |
| APPPDAQDLITLLLRQNPLERLGTGGAYEVKQHRFFRSLDWNSLLRQKAEFIPQLESEDDTSYFDTRSEKYHHMETEEEDD |
| TNDEDFNVEIRQFSSCSHRFSKVFSSIDRITQNSAEEKEDSVDKTKSTTLPSTETLSWSSEYSEMQQLSTSNSSDTESNRH |
| KLSSGLLPKLAISTEGEQDEAASCPGDPHEEPGKPALPPEECAQEEPEVTTPASTISSSTLSVGSFSEHLDQINGRSECVD |
| STDNSSKPSSEPASHMARQRLESTEKKKISGKVTKSLSASALSLMIPGDMFAVSPLGSPMSPHSLSSDPSSSRDSSPSRDS |
| SAASASPHQPIVIHSSGKNYGFTIRAIRVYVGDSDIYTVHHIVWNVEEGSPACQAGLKAGDLITHINGEPVHGLVHTEVIE |
| LLLKSGNKVSITTTPFENTSIKTGPARRNSYKSRMVRRSKKSKKKESLERRRSLFKKLAKQPSPLLHTSRSFSCLNRSLSS |
| GESLPGSPTHSLSPRSPTPSYRSTPDFPSGTNSSQSSSPSSSAPNSPAGSGHIRPSTLHGLAPKLGGQRYRSGRRKSAGNI |
| PLSPLARTPSPTPQPTSPQRSPSPLLGHSLGNSKIAQAFPSKMHSPPTIVRHIVRPKSAEPPRSPLLKRVQSEEKLSPSYG |
| SDKKHLCSRKHSLEVTQEEVQREQSQREAPLQSLDENVCDVPPLSRARPVEQGCLKRPVSRKVGRQESVDDLDRDKLKAKV |
| VVKKADGFPEKQESHQKSHGPGSDLENFALFKLEEREKKVYPKAVERSSTFENKASMQEAPPLGSLLKDALHKQASVRASE |
| GAMSDGPVPAEHRQGGGDFRRAPAPGTLQDGLCHSLDRGISGKGEGTEKSSQAKELLRCEKLDSKLANIDYLRKKMSLEDK |
| EDNLCPVLKPKMTAGSHECLPGNPVRPTGCQQEPPPASESRAFVSSTHAAQMSAVSFVPLKALTGRVDSGTEKPGLVAPES |
| PVRKSPSEYKLEGRSVSCLEPIEGTLDIALLSGPQASKTELPSPESAQSPSPSGDVRASVPPVLPSSSGKKNDTTSARELS |
| PSSLKMNKSYLLEPWFLPPSRGLQNSPAVSLPDPEFKRDRKGPHPTARSPGTVMESNPQQREGSSPKHQDHTTDPKLLTCL |
| GQNLHSPDLARPRCPLPPEASPSREKPGLRESSERGPPTARSERSAARADTCREPSMELCFPETAKTSDNSKNLLSVGRTH |
| PDFYTQTQAMEKAWAPGGKTNHKDGPGEARPPPRDNSSLNSAGIPCEKELGKVRRGVEPKPEALLARRSLQPPGIESEKSE |
| KLSSFPSLQKDGAKEPERKEQPLQRHPSSIPPPPLTAKDLSSPAARQHCSSPSHASGREPGAKPSTAEPSSSPQDPPKPVA |
| AHSESSSHKPRPGPDPGPPKTKHPDRSLSSQKPSVGATKGKEPATQSLGGSSREGKGHSKSGPDVFPATPGSQNKASDGIG |
| QGEGGPSVPLHTDRAPLDAKPQPTSGGRPLEVLEKPVHLPRPGHPGPSEPADQKLSAVGEKQTLSPKHPKPSTVKDCPTLC |
| KQTDNRQTDKSPSQPAANTDRRAEGKKCTEALYAPAEGDKLEAGLSFVHSENRLKGAERPAAGVGKGFPEARGKGPGPQKP |
| PTEADKPNGMKRSPSATGQSSFRSTALPEKSLSCSSSFPETRAGVREASAASSDTSSAKAAGGMLELPAPSNRDHRKAQPA |
| GEGRTHMTKSDSLPSFRVSTLPLESHHPDPNTMGGASHRDRALSVTATVGETKGKDPAPAQPPPARKQNVGRDVTKPSPAP |
| NTDRPISLSNEKDFVVRQRRGKESLRSSPHKKAL |

The NOV5 amino acid sequence has 613 of 926 amino acid residues (66%) identical to, and 706 of 926 amino acid residues (76%) similar to, a *Mus musculus* 1734 amino acid residue microtubule associated testis specific serine/threonine protein kinase (205-kda testis-specific serine/threonine protein kinase MAST205) (ptnr:SPTREMBL-ACC:Q60592) (E=0.0).

NOV5 is expressed in at least the following tissues: Adipose, Adrenal Gland/Suprarenal gland, Amygdala, Aorta, Artery, Bone Marrow, Brain, Bronchus, Brown Adipose, Cerebral Medulla/Cerebral white matter, Cervix, Chorionic Villus, Colon, Coronary Artery, Dermis, Duodenum, Heart, Hippocampus, Hypothalamus, Kidney, Lung, Lung Pleura, Lymph node, Lymphoid tissue, Mammary gland/Breast, Esophagus, Ovary, Oviduct/Uterine Tube/Fallopian tube, Pancreas, Parotid Salivary glands, Peripheral Blood, Pituitary Gland, Placenta, Prostate, Respiratory Bronchiole, Retina, Cerebellum, Skeletal Muscle, Skin, Small Intestine, Spinal Chord, Spleen, Stomach, Substantia Nigra, Temporal Lobe, Testis, Thymus, Thyroid, Tonsils, Umbilical Vein, Urinary Bladder, Uterus, Vein and Vulva. This information was derived by determining the tissue sources of the sequences that were included in the invention including but not limited to SeqCalling sources, Public EST sources, genomic clone sources, literature sources, and/or RACE sources. In addition, NOV5 is predicted to be expressed in testis tissue because of the expression pattern of a closely related *Mus musculus* MAST205 protein kinase mRNA homolog (GENBANK-ID: gb:GENBANK-ID:MMU023113|acc:U02313.1).

NOV5 has homology to the amino acid sequences shown in the BLASTP data listed in Table 5C.

TABLE 5C

BLAST results for NOV5

| Gene Index/ Identifier | Protein/Organism | Length (aa) | Identity (%) | Positives (%) | Expect |
|---|---|---|---|---|---|
| gi\|4589590\|dbj\|BAA76817.1\| (AB023190) | KIAA0973 protein [Homo sapiens] | 1583 | 744/1341 (55%) | 868/1341 (64%) | 0.0 |
| gi\|14732014\|ref\|XP_045292.1\| (XM_045292) | KIAA0303 protein [*Homo sapiens*] | 2092 | 1847/2092 (88%) | 1849/2092 (88%) | 0.0 |
| gi\|3043646\|dbj\|BAA25487.1\| (AB011133) | KIAA0561 protein [*Homo sapiens*] | 1308 | 664/1184 (56%) | 779/1184 (65%) | 0.0 |
| gi\|2224547\|dbj\|BAA20762.1\| (AB002301) | KIAA0303 [*Homo sapiens*] | 2137 | 1893/2137 (88%) | 1894/2137 (88%) | 0.0 |
| gi\|6678958\|ref\|NP_032667.1\| (NM_008641) | microtubule associated testis specific serine/threonine protein kinase [*Mus musculus*] | 1734 | 804/1424 (56%) | 924/1424 (64%) | 0.0 |

The homology of these sequences is shown graphically in the ClustalW analysis shown in Table 5D.

Table 5D Clustal W Sequence Alignment

1) NOV5 (SEQ ID NO:12)
2) gi|4589590|dbj|BAA76817.1| (AB023190) KIAA0973 protein [Homo sapiens] (SEQ ID NO:78)

3) gi|14732014|ref|XP_045292.1| (XM_045292) KIAA0303 protein [Homo sapiens] (SEQ ID NO:79)
4) gi|3043646|dbj|BAA25487.1| (AB011133) KIAA0561 protein [Homo sapiens] (SEQ ID NO:80)
5) gi|2224547|dbj|BAA20762.1| (AB002301) KIAA0303 [Homo sapiens] (SEQ ID NO:81)
6) gi|6678958|ref|NP_032667.1| (NM_008641) microtubule associated testis specific serine/threonine prote kinase [Mus musculus] (SEQ ID NO:82)

```
                     10        20        30        40        50        60        70
             ....|....|....|....|....|....|....|....|....|....|....|....|....|....|
NOV5         MEGCFQKIKLDHILSPPPMPFRKCSNPDVASGPGKSLKYKRQLSEDGRQLRRGSLGGALTGRYLLPNPVA
gi|4589590|  ----------------------------------LLPHLPPCRRRRVMS---------------------
gi|14732014| ----------------------------------------------------------------------
gi|3043646|  -----------------------------------DESSLLRRRG-------------------------
gi|2224547|  ----------------------------------------------------------------------
gi|6678958|  ----------------------------------MVTGLSPLLFRKLSNPDIFAPTGKVKLQRQLSQDDC

                     80        90       100       110       120       130       140
             ....|....|....|....|....|....|....|....|....|....|....|....|....|....|
NOV5         GQAWPASAETSPLVRMRSQALGQSAPSLTASLKELSLPRRGSFLTPRSLSPTPSSPGSPCSPLLAFHFWS
gi|4589590|  ----DSLWTALSN----------------------------------------FSMPSFPGG----SMFRRTK
gi|14732014| ----------------------------------------------------------------------
gi|3043646|  ------LQKELS---------------------------------------------------LPRRGR
gi|2224547|  ----------------------------------------------------------------------
gi|6678958|  KLRRGSLASSLPGKQLLPLSSSVHSSVGQVTWQSTGEASNLVRMRNQSLGQSAPSLTAGLKELSLPRRGS

                    150       160       170       180       190       200       210
             ....|....|....|....|....|....|....|....|....|....|....|....|....|....|
NOV5         PVCPNAGCRTSNRKSLIGNGQSPALSRPHSPLSAHAGSSPSDSPRNFSPSASAHFSFARRTDGRRWSLAS
gi|4589590|  SCRTSNRKSLIGTS-TSPSLPRSHSPLPG-HLGSSPLDSPRNFSPNTPAHFSFASSRRADGRRWSLASLP
gi|14732014| ----------------------------------------------------------------------
gi|3043646|  GCRSGNRKSLVGGT-PSPSLSRPLSPLSVPTAGSSPLDSPRNFSAASALNFPFA--RRADGRRWSLASLP
gi|2224547|  ----------------------------------------------------------------------
gi|6678958|  FCRTSNRKSLIGTSSTSPSLPRSHSPLHG-HTGNSPLDSPRNFSPNAPAHFSFVPARRTDGRRWSLASLP

                    220       230       240       250       260       270       280
             ....|....|....|....|....|....|....|....|....|....|....|....|....|....|
NOV5         LPSSGYGTNPPSSSVSSSCSSSEKLHQLPFYQPTPDELHFLSKHFCTTESIATENRCRNTPMRPRSRSLSP
gi|4589590|  SSGYGTNTPSSVSSSCSSQEKLHQLPYQPTVDELHFLSKHFGSTESITDEDGGRRSPAVRPRSRSLSPG
gi|14732014| ----------------------------------------------------------------------
gi|3043646|  SSGYGTNTPSSPLSSSSSREKLHQLPFQPTPDELHFLSKHFRSSENVLDEEG-GRSPRLRPRSRSLSPG
gi|2224547|  ----------------------------------------------------------------------
gi|6678958|  SSGYGTNTPSSVSSSCSSQEKLHQLPFQPTADELHFLTKHF-STENVPDEEG-RRSPRMRPRSRSLSPG

                    290       300       310       320       330       340       350
             ....|....|....|....|....|....|....|....|....|....|....|....|....|....|
NOV5         GRSPACCDHEIKNMSHVYKERFPKATAQMEERLKEIITSFSSDNVLPLASCVISSTHHQCEPARDCLDE
gi|4589590|  RSPSSYDNEIKKNEVYKERFPKATAQMEEK-LRDFTRSSEDDSVLPLASCVISSIHHQCEPARDCLTE
gi|14732014| ----------------------------------------------------------------------
gi|3043646|  RATGTFDNEIKKNEVYRERFPKATAQMEGR-LQEFLTAFAEGSRPALADSVLGSIHFQCEPARDCLAE
gi|2224547|  ----------------------------------------------------------------------
gi|6678958|  RSPVSFDSEIKKNEVYKERFPKATAQMEERPSLTFISSNTEDSVLPLADCALSSIHHQCEPARDCLDE

                    360       370       380       390       400       410       420
             ....|....|....|....|....|....|....|....|....|....|....|....|....|....|
NOV5         SHQELRTSRRVFLESKHKEPLLLQPARDRSKSGRGAFAKQLVRKHSIGIGRPARLLECLEFDPEEFYRLLL
gi|4589590|  SRDGLIALVYFYESKENLEPLLLQPAPSRSSSLEPAFSTQLVRKFLSIGISRPARLLECLEFDPEEFYNLLE
gi|14732014| ----------------------------------------------------------------------
gi|3043646|  SGENLSSRRVYFLESKEKLRPLLLQPAGERSGSEEYSSPVQLVRRHSIGISRPARLLECLEFDPEEFYHLLE
gi|2224547|  ---------------------------------------------------------EFDPEEFYHLLE
gi|6678958|  SRSSLKTSHYFYREKENLAPLLLQPAESRSESSPAPAFIQLVSKHSIGIGRFARLLECIEFDPEEFYHLLE

                    430       440       450       460       470       480       490
             ....|....|....|....|....|....|....|....|....|....|....|....|....|....|
NOV5         AAEGHAKEGQGIKTDIPRYIISQLGLNKDPLEEMAHLGNYDSGTAETPETDESVSSSNASLKLRRKPRES
gi|4589590|  AAEGHAKEGHLKKTDIPRYIIRQLGLTRDPFPEAVHLEEQDSSGKNTPPQDSLSEGR--SSKAKKPPGRE
gi|14732014| ------------------------------------MAHLGNYDSGTAETPETDESVSSSNASLKLRRKPRES
gi|3043646|  AAEGHAKEGQGIKTDLPGYIIGQLGLAKDPLEEMVPLSHLEE---EQGPAPEEPESRALVGSSRRKECES
gi|2224547|  AAEGHAKEGQGIKTDIPRYIISQLGLNKDPLEEMAHLGNYDSGTAETPETDESVSSSNASLKLRRKPRES
gi|6678958|  AADGHAKEGHGIKCDIPRYIISQLGLTKDPLEEMAQLSSYDS--PDTPETDESVEGRGVSQPSKKTESPE

                    500       510       520       530       540       550       560
             ....|....|....|....|....|....|....|....|....|....|....|....|....|....|
NOV5         DFETIKLISNGAYGAVYFVRHKESRQRFAMKKINKQNLILRNQIQQAFVERDILTFAENPFVVSMYCSFE
gi|4589590|  DFETIKLISNGAYGAVYLVRHKETRQRFAMKKINKQNLILRNQIQQAFVERDILTFAENPFVVSMFCSFE
gi|14732014| DFETIKLISNGAYGAVYFVRHKESRQRFAMKKINKQNLILRNQIQQAFVERDILTFAENPFVVSMYCSFE
gi|3043646|  DFETIKLISNGAYGAVYLVRHRETRQRFAMKKINKQNLILRNQIQQVFVERDILTFAENPFVVSMFCSFE
gi|2224547|  DFETIKLISNGAYGAVYFVRHKESRQRFAMKKINKQNLILRNQIQQAFVERDILTFAENPFVVSMYCSFE
```

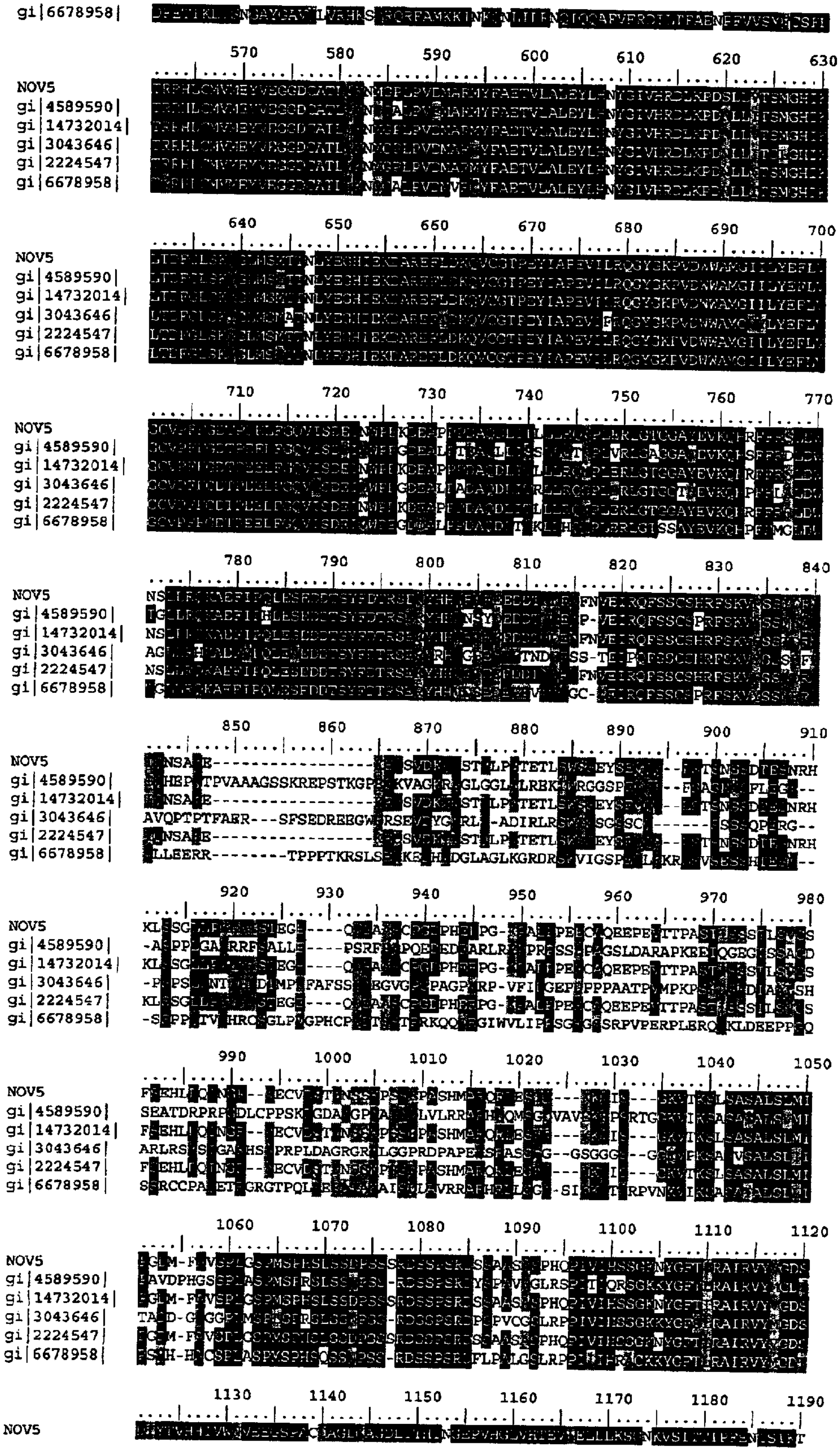
gi|6678958|
NOV5
gi|4589590|
gi|14732014|
gi|3043646|
gi|2224547|
gi|6678958|

```
gi|4589590|   EKPVHHIVWHNEEGHPQERCLQACDLITHNCDIVHCMVLPEMELLLKSCNKVSITTTPFENTSIHI
gi|14732014|  DKYTVHHIVWHNEEGSPACQAGLQACDLITHINGEPVHGLVHTEVRELLLKSCNKVSITTTPFENTSIKT
gi|3043646|   DKYIVHHIVWSVRECSPAQRAGLQACDLITHINGESVLGLVHMDVVELLLKSCNKVSLRTTALENTSIKV
gi|2224547|   DKYTVHHIVWHVEEGSPACQAGLQAGDLITHINGEPVHGLVHTEVVELLLKSCNKVSITTTPFENTSIKT
gi|6678958|   DKYIVHHIVWHVREGPASSAGLQCGDLITHINGEPVHGLVHTEVVELLLKSCNKVSISTTPLENTSIKV

                   1200      1210      1220      1230      1240      1250      1260
              ....|....|....|....|....|....|....|....|....|....|....|....|....|
NOV5          GFARENSYHSRVVRRSHESPRKENLERH--SLFKKLPKKPSPLLHTSRSFSC-LHRSLSSGESLPGSPI
gi|4589590|   GFARHSSYKRAARFHFHPSAKEGQSSLRRSSLFRHRTKPS--LLHTSRSLSS-LNRSLSSSESLPGSPT
gi|14732014|  GFARENSYHSRVVRRSHESPRKENLERR--SLFKKLPKKPSPLLHTSRSFSC-LHRSLSSGESLPGSPI
gi|3043646|   GFAHNVARGRAARRSHESPRKEKQERR--SLFKKLPKKTS-MLHTSRSFSSGLIHSLSSSESLPGSPI
gi|2224547|   GFASHNSYHSRVVRRSHESPRKENLERR--SLFKKLPKKPSPLLHTSRSFSC-LHRSLSSGESLPGSPI
gi|6678958|   GFARGGSYHSRAARRSHESPGKGQESLRRSSLFRHRTKAA--LLHTSRSLSS-LNRSLSSGEGPGSPT

                   1270      1280      1290      1300      1310      1320      1330
              ....|....|....|....|....|....|....|....|....|....|....|....|....|
NOV5          H--LPPRSPTPSYRSTIHFPS--HNSSLSSSLSSSHNSPAGSH--HIRPSTLHGLAPKLHGQRYRSG
gi|4589590|   HG--LPARSPTHSYRSTIPSAY--LGSSSQSSSFPSSTTNSPASSASHHIRPSTLHGLSPKLHR-SYRSA
gi|14732014|  H--LPPRSPTPSYRSTIHFPS--GHNSSLSSSFPSSSHNSPAGSS--HIRPSTLHGLAPKLHGQRYRSG
gi|3043646|   HH--LS-SPTTPCFHPAPDVPADTIAPPSTFPSSSPPTSPAAN--HTRPSTLHGLAAKLHPPSPRS
gi|2224547|   H--LSPRSPTPSYRSTHHFPS--HNSSLSSSFPSSSHNSPAGSH--HIRPSTLHGLAPKLHGQRYRSG
gi|6678958|   HHHSLPPPRSPQGYSVAPSAVHSVHGNSSQSSSSPSSSVFSSPAGSL--HTPPSTLHGIAPKHQR-SYRSP

                   1340      1350      1360      1370      1380      1390      1400
              ....|....|....|....|....|....|....|....|....|....|....|....|....|
NOV5          RRKSACSIFLSPLARTPSPIPQPTSPHFSPSPSPLLGHHLGNSKIASSFFSKSHSPTTTVFHSVRPKSAEPP
gi|4589590|   FQKSACSIFLSPLAHIPSPIQASPPSLPGHSVGSSQST------SSFFSRSHSSTPSVS--PRPKSAEPP
gi|14732014|  RRKSACSIFLSPLARTPSPIPQPTSPQRSPSPSPLLGHHLGNSKIASSFFSKSHSPTTTVFHSVRPKSAEPP
gi|3043646|   RRKTSSIFPSPLACPS----ISAPLPRSPSPIPGH---------------------P--------PAPA
gi|2224547|   RRKSACSIFLSPLARTPSPIPQPTSPQRSPSPSPLLGHHLGNSKIASSFFSKSHSPTTTVFHSVRPKSAEPP
gi|6678958|   RRKSACSIPLSPLAHTPSIPATAAPPQRSPSPSPLSGHGS------SSFFSKSHLLSTPSGLQSSRPKSAEPP

                   1410      1420      1430      1440      1450      1460      1470
              ....|....|....|....|....|....|....|....|....|....|....|....|....|
NOV5          RSPLLKRVQSEEKLSPSYGSDKK-HLCSRKHSLEVTQEEVQREQSQR---EAPLQSLDENVCDVPPLSRA
gi|4589590|   RSPLLKRVQSAEKLGAPLSSDKK--GALRKHSLEVGHPDFRGDFHG----SLASHSLAFSDGPTPSLEGL
gi|14732014|  RSPLLKRVQSEEKLSPSYGSDKK-HLCSRKHSLEVTQEEVQREQSQR---EAPLQSLDENVCDVPPLSRA
gi|3043646|   RSHRLLGQSAEKLG---TG--------------------E----------------SDGSAGRRSFG
gi|2224547|   RSPLLKRVQSEEKLSPSYGSDKK-HLCSRKHSLEVTQEEVQREQSQR---EAPLQSLDENVCDVPPLSRA
gi|6678958|   RSPLLKRVQSATKLAALASAPKKLAPSRKHSLDVPHGEAQREQLSPREASPLEAVGTRSLSSGKGPLPGK

                   1480      1490      1500      1510      1520      1530      1540
              ....|....|....|....|....|....|....|....|....|....|....|....|....|
NOV5          RPVEQSCLSRPVSRSEGRQESVDDLDRDKLKAKVVVKKADGFPEKQESHQKSHGPGSDLENFALFKLEEE
gi|4589590|   -----SAPKAVAVPAQGRQE-------------------------------------------SPRSLG
gi|14732014|  RPVEQSCLSRPVSRSEGRQESVDDLDRDKLKAKVVVKKADGFPEKQESHQKSHGPGSDLENFALFKLEEE
gi|3043646|   -----PEALLVAMPPSH------------------------------------------------LSEE
gi|2224547|   RPVEQSCLSRPVSRSEGRQESVDDLDRDKLKAKVVVKKADGFPEKQESHQKSHGPGSDLENFALFKLEEE
gi|6678958|   -----SVLSPAPSSASSTLR---------------------------------------------QDRAEE

                   1550      1560      1570      1580      1590      1600      1610
              ....|....|....|....|....|....|....|....|....|....|....|....|....|
NOV5          EKKVYPKAVERSSTFENKASMQEAPPLGSLLKEGLHEQAEVLASEGLMSLGPVPAEHRSGGGSFPRSLAE
gi|4589590|   ---------------------------------ASPLLPGGESLPPVSAKE--KESPGGASACTPPSATTP-
gi|14732014|  EKKVYPKAVERSSTFENKASMQEAPPLGSLLKEGLHEQAEVLASEGLMSLGPVPAEHRSGGGSFPRSLAE
gi|3043646|   ---------------------------------EEFKKGEAVGEVSFDEP--------------------
gi|2224547|   EKKVYPKAVERSSTFENKASMQEAPPLGSLLKEGLHEQASVLASEGLMSLGPVPAEHRSGGGSFPRSHAE
gi|6678958|   ---------------------------------EEQKKEEAVEEVSSSEDPTDEEPESSSATQSPSLSHE

                   1620      1630      1640      1650      1660      1670      1680
              ....|....|....|....|....|....|....|....|....|....|....|....|....|
NOV5          GTLQEGLCHSLDRGISGKGEGTEESSQAKELLRCEKLDSKLANIDYLRKKMSSEDKEDNLCPVLKPKMTA
gi|4589590|   ------------------GSRTLEEDV---------------------GCTSHQSSTT--------------
gi|14732014|  GTLQEGLCHSLDRGISGKGEGTEESSQAKELLRCEKLDSKLANIDYLRKKMSSEDKEDNLCPVLKPKMTA
gi|3043646|   ------------------------------------------------------Q---------------
gi|2224547|   GTLQEGLCHSLDRGISGKGEGTEESSQAKELLRCEKLDSKLANIDYLRKKMSSEDKEDNLCPVLKPKMTA
gi|6678958|   EASHE-------LLPKGSGEGTEEDE------------------------SLHSDSKKSG--------------

                   1690      1700      1710      1720      1730      1740      1750
              ....|....|....|....|....|....|....|....|....|....|....|....|....|
NOV5          GSHECLPGNPVRPTGGQQEPPPASESRAFVSSTHAAQMSAVSFVPLKAEGGRRDSGTEKPGLVAPESPVR
gi|4589590|   ----------------------------------------------EDGTG---G---------------
gi|14732014|  GSHECLPGNPVRPTGGQQEPPPASESRAFVSSTHAAQMSAVSFVPLKAEGGRRDSGTEKPGLVAPESPVR
gi|3043646|   ----------------------------------------------EEARG-------------------
gi|2224547|   GSHECLPGNPVRPTGGQQEPPPASESRAFVSSTHAAQMSAVSFVPLKAEGGRRDSGTEKPGLVAPESPVR
gi|6678958|   ----------------------------------------------PVESGLSTG---------------
```

```
                 1760      1770      1780      1790      1800      1810      1820
             ....|....|....|....|....|....|....|....|....|....|....|....|....|....|
NOV5         KSPSEYKLEGRSVSCLEPIEGTLDIALLSGPQASKTELPSPESAQSPSPSGDVRASVPPVLPSSSGRGND
gi|4589590|  -----------------------------------------------MARAVAKEASPVQEHESCSRSS
gi|14732014| KSPSEYKLKEGRSVSCLKPIEGTLDIALLSGPQASKTELPSPESAQSPSPSGDVRASVPPVLPSSSGRGND
gi|3043646|  -----------------------------------------------LPGSVPRIHSEGEE---------
gi|2224547|  KSPSEYKLEGRSVSCLEPIEGTLDIALLSGPQASKTELPSPESAQSPSPSGDVRASVPPVLPSSSGRGND
gi|6678958|  -----------------------------------------------TTLKSPEVDVAGESPRKVSPPQA

                 1830      1840      1850      1860      1870      1880      1890
             ....|....|....|....|....|....|....|....|....|....|....|....|....|....|
NOV5         PTSPRELSPSSLKMNKSYLLEPWFLPPSRGLQNSPAVSLPDPEFKRDRKGPHPTARSPGSTMESNPQQRE
gi|4589590|  SGEA----------------------------------------------GSPLVSIVSEPPRPG---
gi|14732014| PTSPRELSPSSLKMNKSYLLEPWFLPPSRGLQNSPAVSLPDPEFKRDRKGPHPTARSPGSTMESNPQQRE
gi|3043646|  ----------------------------------------------------------------------
gi|2224547|  PTSPRELSPSSLKMNKSYLLEPWFLPPSRGLQNSPAVSLPDPEFKRDRKGPHPTARSPGSTMESNPQQRE
gi|6678958|  FEEA----------------------------------------------TNPLQVPSSSRSGPTSPT

                 1900      1910      1920      1930      1940      1950      1960
             ....|....|....|....|....|....|....|....|....|....|....|....|....|....|
NOV5         GPSPKHPDHTTDSPLLKCPGQNLHSPDLARPRCPLPPEASPSREKPGLRESPERGSPTARSERSAERADP
gi|4589590|  -------AKAVVGPPLGAD--------------------------SKPGLRSPPLAP-------SVPEAPR
gi|14732014| GPSPKHPDHTTDSPLLKCPGQNLHSPDLARPRCPLPPEASPSREKPGLRESPERGSPTARSERSAERADP
gi|3043646|  ----------------------------------------------AVP------------VPLGPP
gi|2224547|  GPSPKHPDHTTDSPLLKCPGQNLHSPDLARPRCPLPPEASPSREKPGLRESPERGSPTARSERSAERADP
gi|6678958|  PSEGCWPAQHLHTSPLKAP-------------------------CPSFSPLAPTPC-------SPPTPTP

                 1970      1980      1990      2000      2010      2020      2030
             ....|....|....|....|....|....|....|....|....|....|....|....|....|....|
NOV5         CPPPPMEPCPPPTAKPSDNPANLPPVGRTHPDFYTQTQAMEKAWAPGGKTNHKDGPGEARPPPRDNSSLH
gi|4589590|  GRP-RWVPEVVPERTPLSGP--------------------------------------------------
gi|14732014| CPPPPMEPCPPPTAKPSDNPANLPPVGRTHPDFYTQTQAMEKAWAPGGKTNHKDGPGEARPPPRDNSSLH
gi|3043646|  GPP-------------------------------------------------------------------
gi|2224547|  CPPPPMEPCPPPTAKPSDNPANLPPVGRTHPDFYTQTQAMEKAWAPGGKTNHKDGPGEARPPPRDNSSLH
gi|6678958|  GPPGPWSWKPLIEGPDRASPNKTPPR--------------------------------------------

                 2040      2050      2060      2070      2080      2090      2100
             ....|....|....|....|....|....|....|....|....|....|....|....|....|....|
NOV5         SAGIPCEKELPPVRPGVPPPPEALPARPPPQPPGIPSEPPEKPPSFPSLQKPGAKPPERKPQPLPPHPSP
gi|4589590|  -------------SKPAS-------KLSPE----PAPPSP---------------------------PAKCP
gi|14732014| SAGIPCEKELPPVRPGVPPPPEALPARPPPQPPGIPSEPPEKPPSFPSLQKPGAKPPERKPQPLPPHPSP
gi|3043646|  ----------------------------------------------------------------------
gi|2224547|  SAGIPCEKELPPVRPGVPPPPEALPARPPPQPPGIPSEPPEKPPSFPSLQKPGAKPPERKPQPLPPHPSP
gi|6678958|  ---------KPPPANSQPTNTTVPNLLPPPSPEEEP-PPPPSPPGLTHPLLPVPSPNWPWPSECPPMEKE

                 2110      2120      2130      2140      2150      2160      2170
             ....|....|....|....|....|....|....|....|....|....|....|....|....|....|
NOV5         IPPPPPPAKDLPPPAAPPHCSSPPPASPREPPAPPSTAEPPSSPQPPPKPVAAHSPPSPHKPPPPPDPGP
gi|4589590|  APSSAPPPVPPPP-------------LLP--SPTKPQVGLTPRCPAPAVPPAGLTKPGVPSPAPPCP----
gi|14732014| IPPPPPPAKDLPPPAAPPHCSSPPPASPREPPAPPSTAEPPSSPQPPPKPVAAHSPPSPHKPPPPPDPGP
gi|3043646|  ----------------------------------------------------------------------
gi|2224547|  IPPPPPPAKDLPPPAAPPHCSSPPPASPREPPAPPSTAEPPSSPQPPPKPVAAHSPPSPHKPPPPPDPGP
gi|6678958|  EPSLSPPPEVPDPPGDRPPDIPCRPPPLS--PETPPPLLWKPQELGGQQDHQDLALTPDELLKPT------

                 2180      2190      2200      2210      2220      2230      2240
             ....|....|....|....|....|....|....|....|....|....|....|....|....|....|
NOV5         PKTKHPDRSLSSQKPSVGATKGKEPATQSLGGSSREGKGHSKSGPDVFPATPGSQNKASDGIGQGEGGPS
gi|4589590|  ----------------------------------------------------------------------
gi|14732014| PKTKHPDRSLSSQKPSVGATKGKEPATQSLGGSSREGKGHSKSGPDVFPATPGSQNKASDGIGQGEGGPS
gi|3043646|  ----------------------------------------------------------------------
gi|2224547|  PKTKHPDRSLSSQKPSVGATKGKEPATQSLGGSSREGKGHSKSGPDVFPATPGSQNKASDGIGQGEGGPS
gi|6678958|  ----------------------------------------------------------------------

                 2250      2260      2270      2280      2290      2300      2310
             ....|....|....|....|....|....|....|....|....|....|....|....|....|....|
NOV5         VPLHTDRAPLDAKPQPTSGGRPLEVLEKPVHLPRPGHPGPSEPADQKLSAVGEKQTLSPKHPKPSTVKDC
gi|4589590|  ----------------------------------------------------------------------
gi|14732014| VPLHTDRAPLDAKPQPTSGGRPLEVLEKPVHLPRPGHPGPSEPADQKLSAVGEKQTLSPKHPKPSTVKDC
gi|3043646|  ----------------------------------------------------------------------
gi|2224547|  VPLHTDRAPLDAKPQPTSGGRPLEVLEKPVHLPRPGHPGPSEPADQKLSAVGEKQTLSPKHPKPSTVKDC
gi|6678958|  ----------------------------------------------------------------------

                 2320      2330      2340      2350      2360      2370      2380
             ....|....|....|....|....|....|....|....|....|....|....|....|....|....|
NOV5         PTLCKQTDNRQTDKSPSQPAANTDRRAEGKKCTEALYAPAEGDKLEAGLSFVHSENRLKGAERPAAGVGK
gi|4589590|  ----------------------------------------------------------------------
```

```
gi|14732014|  PTLCKQTDNRQTDKSPSQPAANTDRRAEGKKCTEALYAPAEGDKLEAGLSFVHSENRLKGAERPAAGVGK
gi|3043646|   ----------------------------------------------------------------------
gi|2224547|   PTLCKQTDNRQTDKSPSQPAANTDRRAEGKKCTEALYAPAEGDKLEAGLSFVHSENRLKGAERPAAGVGK
gi|6678958|   ----------------------------------------------------------------------

                        2390      2400      2410      2420      2430      2440      2450
              ....|....|....|....|....|....|....|....|....|....|....|....|....|....|
NOV5          GFPEARGKGPGPQKPPTEADKPNGMKRSPSATGQSSFRSTALPEKSLSCSSSFPETRAGVREASAASSDT
gi|4589590|   ----------------------------------------------------------------------
gi|14732014|  GFPEARGKGPGPQKPPTEADKPNGMKRSPSATGQSSFRSTALPEKSLSCSSSFPETRAGVREASAASSDT
gi|3043646|   ----------------------------------------------------------------------
gi|2224547|   GFPEARGKGPGPQKPPTEADKPNGMKRSPSATGQSSFRSTALPEKSLSCSSSFPETRAGVREASAASSDT
gi|6678958|   ----------------------------------------------------------------------

                        2460      2470      2480      2490      2500      2510      2520
              ....|....|....|....|....|....|....|....|....|....|....|....|....|....|
NOV5          SSAKAAGGMLELPAPSNRDHRKAQPAGEGRTHMTKSDSLPSFRVSTLPLESHHPDPNTMGGASHRDRALS
gi|4589590|   ----------------------------------------------------------------------
gi|14732014|  SSAKAAGGMLELPAPSNRDHRKAQPAGEGRTHMTKSDSLPSFRVSTLPLESHHPDPNTMGGASHRDRALS
gi|3043646|   ----------------------------------------------------------------------
gi|2224547|   SSAKAAGGMLELPAPSNRDHRKAQPAGEGRTHMTKSDSLPSFRVSTLPLESHHPDPNTMGGASHRDRALS
gi|6678958|   ----------------------------------------------------------------------

                        2530      2540      2550      2560      2570      2580      2590
              ....|....|....|....|....|....|....|....|....|....|....|....|....|....|
NOV5          VTATVGETKGKDPAPAQPPPARKQNVGRDVTKPSPAPNTDRPISLSNEKDFVVRQRRGKESLRSSPHKKA
gi|4589590|   ----------------------------------------------------------------------
gi|14732014|  VTATVGETKGKDPAPAQPPPARKQNVGRDVTKPSPAPNTDRPISLSNEKDFVVRQRRGKESLRSSPHKKA
gi|3043646|   ----------------------------------------------------------------------
gi|2224547|   VTATVGETKGKDPAPAQPPPARKQNVGRDVTKPSPAPNTDRPISLSNEKDFVVRQRRGKESLRSSPHKKA
gi|6678958|   ----------------------------------------------------------------------

NOV5          L
gi|4589590|   -
gi|14732014|  L
gi|3043646|   -
gi|2224547|   L
gi|6678958|   -
```

Tables 5E–5I list the domain description from DOMAIN analysis results against NOV5. This indicates that the NOV5 sequence has properties similar to those of other proteins known to contain these domains.

TABLE 5E

Domain Analysis of NOV5

```
gnl Smart|smart00220, S_TKc, Serine/Threonine protein kinases,
catalytic domain; Phosphotransferases. Serine or threonine-specific
kinase subfamily. (SEQ ID NO:83)
Length = 256 residues, 100.0% aligned
Score = 286 bits (731), Expect = 1e-77

NOV5:   492 FETIKLISNGAYGAVYFVRHKESRQRFAMKKINKQNLILRNQIQQAFVERDILTFAENPF   551
            +| ++++  ||+| ||   | |++ +  "+| | |+ |  + + ++    |  ||  ++|
00220:    1 YELLEVLGKGAFGKVYLARDKKTGKLVAIKVIKKEKLK-KKKRERILREIKILKKLDHPN    59

NOV5:   552 VVSMYCSFETRRHLCMVMEYVEGGDCATLMKNMGPLPVDMARMYFAETVLALEYLHNYGI   611
            +| +|  ||     | +|||| ||||    |+|    | |  | || |  + + ||||||+ ||
00220:   60 IVKLYDVFEDDDKLYLVMEYCEGGDLFDLLKKRGRLSEDEARFYARQILSALEYLHSQGI   119

NOV5:   612 VHRDLKPDSLLVTSMGHIKLTDFGLSKVGLMSMTTNLYEGHIEKDAREFLDKQVCGTPEY   671
            +||||||+++|+ | ||+|| ||||+|               + |+   |     |||||
00220:  120 IHRDLKPENILLDSDGHVKLADFGLAK---------------QLDSGGTLLTTFVGTPEY   164

NOV5:   672 IAPEVILRQGYGKPVDWWANGIILYEFLVGCVPFFG-DTPEELFGQVISDEINWPEKDEA   730
            +||||+| +|||| || |++|+|||| | |   || | |    || ++      +|  +
00220:  165 MAPEVLLGKGYGKAVDIWSLGVILYELLTGKPPFPGDDQLLALFKKIGKPPPPFPPPEWK   224

NOV5:   731 PPPDAQDLITLLLRQNPLERLGTGGAYEVKQHRFF                           765
              |+|+|||   || ++| +||    | |  +| ||
00220:  225 ISPEAKDLIKKLLVKDPEKRL---TAEEALEEPFF                           256
```

TABLE 5F

Domain Analysis of NOV5

```
gnl Pfam pfam00069, pkinase, Protein kinase domain. (SEQ ID NO:84)
Length = 256 residues, 100.0% aligned
Score = 222 bits (565), Expect = 2e-58

NOV5:   492 FETIKLISNGAYGAVYFVRHKESRQRFAMKKINKQNLILRNQIQQAFVERDILTFAENPF   551
            +|  + + +||+|  ||  +||++ +  |+| + |++|  + +  +    |   ||    +|
00069:    1 YELGEKLGSGAFGKVYKGKHKDTGEIVAIKILKKRSLSEKKK--RFLREIQILRRLSHPN    58

NOV5:   552 VVSMYCSFETRRHLCMVMEYVEGGDCATLMKNMGP-LPVDMARMYFAETVLALEYLHNYG   610
            +| +    ||    || +||||+||||    ++   |  |    |+    + +  |||||+ |
00069:   59 IVRLLGVFEEDDHLYLVMEYMEGGDLFDYLRRNGLLLSEKEAKKIALQILRGLEYLESRG   118

NOV5:   611 IVHRDLKPDSLLVTSMGHIKLTDFGLSKVGLMSMTTNLYEGHIEKDAREFLDKQVCGTPE   670
            ||||||||+++|+    | +|+ ||||++               +|  + | |    ||||
00069:  119 IVHRDLKPENILLDENGTVKIADFGLARK-------------LESSSYEKL-TTFVGTPE   164

NOV5:   671 YIAPEVILRQGYGKPVDWWAMGIILYEFLVGCVPFFGDTPEELFGQVISDEINWPEKDEA   730
            |+||||+  +||     || |++|+|||| | | +|| |  | |  ++
00069:  165 YMAPEVLEGRGYSSKVDVWSLGVILYELLTGKLPFPGIDPLEELFRIKERPRLRLPLPPN   224

NOV5:   731 PPPDAQDLITLLLRQNPLERLGTGGAYEVKQHRFF                           765
              + +|||   | ++| +|     | |+  | +|
00069:  225 CSEELKDLIKKCLNKDPEKRP---TAKEILNHPWF                           256
```

TABLE 5G

Domain Analysis of NOV5

```
gnl Smart|smart00219, TyrKc, Tyrosine kinase, catalytic domain;
Phosphotransferases. Tyrosine-specific kinase subfamily. (SEQ ID NO:85)
Length = 258 residues, 94.6% aligned
Score = 110 bits (275), Expect = 1e-24

NOV5:   496 KLISNGAYGAVY---FVRHKESRQRFANKKINKQNLILRNQIQQAFVERDILTFAENPFV   552
            | +  ||+| ||               |+| + +        ||++   |  ++   ++| +
00219:    5 KKLGEGAFGEVYKGTLKGKGGVEVEVAVKTLKEDASE--QQIEEFLREARLMRKLDEPNI    62

NOV5:   553 VSMYCSFETRRHLCMVMEYVEGGDCATLMKNMGPLPVDMARM-YFAETV-LALEYLHNYG   610
            | +          | +||||+||||    ++    |  + ++ +  ||  +   +||| +
```

TABLE 5G-continued

Domain Analysis of NOV5

```
00219:   63 VKLLGVCTEEEPLMIVMEYMEGGDLLDYLRKNRPKELSLSDLLSFALQIARGMEYLESKN  122

NOV5:   611 IVRDLKPDSLLVTSMGHIKLTDFGLSKXTGLMSMTTNLYEGHIEKDAREFLDKQVCGTPE  670
              |||||    + ||      +|+ ||||++        +||+            +   +|
00219:  123 FVHRDLAARNCLVGENKTVKIADFGLAR--------DLYDDD---------YYRKKKSPR  165

NOV5:   671 ----YIAPEVILRQGYGKPVDWWAMGIILYEFLVGC-VPFFGDTPEELFGQVISDEINWP  725
                ++||| +     +     |  |+ |++|+|        |+ | + ||+    +
00219:  166 LPIRWMAPESLKDGKFTSKSDVNSFGVLLWEIFTLGESPYPGMSNEEVLEYLKKGYRLPQ  225

NOV5:   726 EKDEAPPPDAQDLITLLLRQNPLER                                    750
               +    | +  ||+     ++| +|
00219:  226 PPN--CPDEIYDLMLQCWAEDPEDR                                    248
```

TABLE 5H

Domain Analysis of NOV5 gnl Smart|smart00228, PDZ, Domain present in PSD-95, Dlg, and ZO-1/2.; Also called DHR (DLg homologous region) or GLGF (relatively well conserved tetrapeptide in these domains). Some PDZs have been shown to bind C-terminal polypeptides; others appear to bind internal (non-C-terminal) polypeptides. Different PDZs possess different binding specificities. (SEQ ID NO:86)
Length = 86 residues, 89.5% aligned
Score = 73.2 bits (178), Expect = 2e-13

```
NOV5:  1064 IVIHSSGKNYGFTIRAIRVYVGDSDIYTVHHIVWNVEEGSPACQAGLKAGDLITHINGEP  1123
            + +     |     ||++        ||   |        +| +|   |||| +|||| ||+|  +|
00228:    5 VELEKGGGGLGFSL------VGGKDSGDGGVVVSSVVPGSPAAKAGLKPGDVILEVNGTS    58

NOV5:  1124 VHGLVHTEVIELLLKSGNKVSIT                                      1146
             | || | | ++|| ++| ||++|
00228:   59 VEGLTHLEAVDLLKEAGGKVTLT                                        81
```

TABLE 5I

Domain Analysis of NOV5 gnl Pfam;pfam00595, PDZ, PDZ domain (Also known as DER or GLGF) . . . PDZ domains are found in diverse signaling proteins. (SEQ ID NO:87)
Length = 81 residues, 96.3% aligned
Score = 53.5 bits (127), Expect = 1e-07

```
NOV5:  1064 IVIHSSGKNY-GFTIRAIRVYVGDSDIYTVHHIVWNVEEGSPACQAGLKAGDLITHINGE  1122
              - -    |-    ||--         | ||        -|  |   |   | - ||| || |   |||-
00595:    2 VTLERQGRGGLGFSL------KGGSDKGDQGIVVSEVLPGGAAERGGLKEGDRILEINGQ    55

NOV5:  1123 PVHGLVHTEVIELLLKSGNKVSIT                                     1146
             |  + |    +   |   || +|++|
00595:   56 DVENVTHERAVLALKGSGGEVTLT                                       79
```

The NOV5 gene encodes for a protein that is a serine/threonine kinase with homology to an intracellular kinase MAST205. MAST205 was initially identified as a kinase associated with spermatid microtubules and shown to be more active during spermiogenesis. Recently, interaction of MAST205 with beta-syntrophin via their PDZ domains, and localization of these two proteins at the neuromuscular junction was demonstrated. It is, therefore, likely that the protein encoded by the gene of invention has similar functions.

To identify proteins which interact with and potentially modulate the function of microtubules during spermatogenesis, a total testis MAP (microtubule-associated protein) antiserum was prepared and used it to isolate cDNA clones from a mouse testis cDNA expression library. Antibodies affinity purified by using one expression clone recognized a 205-kDa protein, termed MAST205, which colocalizes with the spermatid manchette. Sequencing of full-length cDNA clones encoding MAST205 revealed it to be a novel serine/threonine kinase with a catalytic domain related to those of the A and C families. The testis-specific MAST205 RNA increases in abundance during prepuberal testis development, peaking at the spermatid stage. The microtubule-binding region of MAST205 occupies a central region of the molecule including the kinase domain and sequences C terminal to this domain. Binding of MAST205 to microtubules requires interaction with other MAPs, since it does not bind to MAP-free tubulin. A 75-kDa protein associated with immunoprecipitates of MAST205 from extracts of both whole testis and testis microtubules becomes phosphorylated in in vitro kinase assays. This 75-kDa substrate of the MAST205 kinase may form part of the MAST205 protein complex which binds microtubules. The MAST205 protein complex may function to link the signal transduction pathway with the organization of manchette microtubules (Walden and Cowan. A novel 205-kilodalton testis-specific serine/threonine protein kinase associated with microtubules of the spermatid manchette. Mol Cell Biol 13(12):7625–35, 1993).

The morphological and biochemical changes that occur in the haploid male germ cell during spermiogenesis facilitate the natural delivery of the paternally imprinted chromosomes into oocytes. Despite the obvious morphological changes, little is known about the molecular events underlying spermiogenesis. A novel 205-kDa manchette microtubule-associated serine/threonine protein kinase (MAST205) was cloned from mouse testis. The objective of the study was to further delineate the role of MAST205 in mammalian spermiogenesis. While MAST205 RNA levels were similar in pachytene spermatocytes, round spermatids, and residual bodies, MAST205 protein could be detected only in round spermatids and residual bodies. Kinase activity associated with MAST205 immunoprecipitates was low in pachytene spermatocytes, high in round spermatids, and maximal in residual bodies, indicating that MAST205-associated kinase activity is modified during spermatid maturation. Furthermore, MAST205 protein and the associated kinase activity were not detected in epididymal spermatozoa, indicating that MAST205 protein is either excluded from, or degraded in, the latter cell type. Multiple heterologous protein species were seen in immunoprecipitates from 35S-labeled mouse seminiferous tubules using an affinity-purified MAST205 antiserum. Consistent with this observation, MAST205 eluted as part of a 1–2×10(6) dalton protein complex when extracts of mouse testis were fractionated by Superose 6 column chromatography. MAST205 mRNA was detected in human testis indicative of conservation in other mammalian species. Taken together, these results indicate that the MAST205 complex functions in spermatid maturation in mammals (Walden and Millette, Increased activity associated with the MAST205 protein kinase complex during mammalian spermiogenesis. Biol Reprod 55(5):1039–44, 1996).

A screen for proteins that interact with beta 2-syntrophin led to the isolation of MAST205 (microtubule-associated serine/threonine kinase-205 kD) and a newly identified homologue, SAST (syntrophin-associated serine/threonine kinase). Binding studies showed that beta 2-syntrophin and MAST205/SAST associated via a PDZ-PDZ domain interaction. MAST205 colocalized with beta 2-syntrophin and utrophin at neuromuscular junctions. SAST colocalized with syntrophin in cerebral vasculature, spermatic acrosomes and neuronal processes. SAST and syntrophin were highly associated with purified microtubules and microtubule-associated proteins, whereas utrophin and dystrophin were only partially associated with microtubules. Data suggest that MAST205 and SAST link the dystrophin/utrophin network with microtubule filaments via the syntrophins (Lumeng et al., Interactions between beta 2-syntrophin and a family of microtubule-associated serine/threonine kinases. Nat Neurosci 2(7):611–7, 1999).

The above defined information for NOV5 suggests that this NOV5 protein may function as a member of a MAST205 protein family. Therefore, the NOV5 nucleic acids and proteins of the invention are useful in potential therapeutic applications implicated in various diseases and disorders described below and/or other pathologies. For example, the NOV5 compositions of the present invention will have efficacy for treatment of patients suffering from atherosclerosis, aneurysm, hypertension, fibromuscular dysplasia, stroke, scleroderma, obesity, transplantation, adrenoleukodystrophy, congenital adrenal hyperplasia, Von Hippel-Lindau (VHL) syndrome, Alzheimer's disease, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, hemophilia, hypercoagulation, idiopathic thrombocytopenic purpura, allergies, immunodeficiencies, transplantation, graft versus host disease, systemic lupus erythematosus, autoimmune disease, asthma, emphysema, scleroderma, ARDS, cardiomyopathy, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, scleroderma, pancreatitis, diabetes, hypercalceimia, ulcers, fertility, inflammatory bowel disease, diverticular disease, lymphedema, endocrine dysfunctions, growth and reproductive disorders, psoriasis, actinic keratosis, acne, hair growth/loss, allopecia, pigmentation disorders, renal artery stenosis, interstitial nephritis, glomerulonephritis, polycystic kidney disease, renal tubular acidosis, IgA nephropathy, muscular dystrophy, myasthenia gravis, cancer, trauma, regeneration (in vitro and in vivo) and/or viral/bacterial/parasitic infections. The NOV5 nucleic acid encoding the MAST205-like protein, and the MAST205-like-like protein of the invention, or fragments thereof, may further be useful in diagnostic applications, wherein the presence or amount of the nucleic acid or the protein are to be assessed.

NOV6

A disclosed NOV6 nucleic acid of 1119 nucleotides (also referred to as CG56087-01) encoding a novel KILON-like protein is shown in Table 6A. An open reading frame was identified beginning with an ATG initiation codon at nucleotides 17–19 and ending with a TAA codon at nucleotides 1079–1081. Putative untranslated regions upstream from the start codon and downstream from the termination codon are underlined in Table 6A, and the start and stop codons are in bold letters.

TABLE 6A

| NOV6 Nucleotide Sequence |
| --- |
| (SEQ ID NO:13) |
| AGCAGCCCTAGCAGGG**ATG**GACATGATGCTGTTGGTGCAGGGTGCTTGTTGCTCGAACCAGTGGCTGGCGGCGGTGCTCCTC |
| AGCCTGTGCTGCCTGCTACCCTCCTGCCTCCCGGCTGGACAGAGTGTGGACTTCCCCTGGGCGGCCGTGGACAACATGATGG |
| TCAGAAAAGGGGACACGGCGGATTTGAGGTGTTATTTGGAAGATGGAGCTTCAAAGGGTGCCTGGCTGAACCGGTCAAGTAT |
| TATTTTTGCGGGAGGTGATAAGTGGTCAGTGGATCCTCGAGTTTCAATTTCAACATTGAATAAAAGGGACTACAGCCTCCAG |

TABLE 6A-continued

| NOV6 Nucleotide Sequence |
|---|
| ATACAGAATGTAGATGTGACAGATGATGGCCCATACACGTGTTCTGTTCAGACTCAACATACACCCAGAACAATGCAGGTGC |
| ATCTAACTGTGCAAGTTCCTCCTAAGATATATGACATCTCAAATGATATGACCGTCAATGAAGGAACCAACGTCACTCTTAC |
| TTGTTTGGCCACTGGGAAACCAGAGCCTTCCATTTCTTGGCGACACATCTCCCCATCAGCAAAACCATTTGAAAATGGACAA |
| TATTTGGACATTTATGGAATTACAAGGGACCAGGCTGGGGAATATGAATGCAGTGCGGAAAATGATGTGTCATTCCCAGATG |
| TGAGGAAAGTAAAAGTTGTTGTCAACTTTGCTCCTACTATTCAGGAAATTAAATCTGGCACCGTGACCCCCGGACGCAGTGG |
| CCTGATAAGATGTGAAGGTGCAGGTGTGCCGCCTCCAGCCTTTGAATGGTACAAAGGAGAGAAGAAGCTCTTCAATGGCCAA |
| CAAGGAATTATTATTCAAAATTTTAGCACAAGATCCATTCTCACTGTTACCAACGTGACACAGGAGCACTTCGGCAATTATA |
| CTTGTGTGGCTGCCAACAAGCTAGGCACAACCAATGCGAGCCTGCCTCTTAACCCTCCAAGTACAGCCCAGTATGGAATTAC |
| CGGGAGCGCTGATGTTCTTTTCTCCTGCTGGTACCTTGTGTTGACACTGTCCTCTTTCACCAGCATATTCTACCTGAAGAAT |
| GCCATTCTACAA**TAA**ATTCAAAGACCCATAAAAGGCTTTTAAGGATTCTCTGA |

The NOV6 nucleic acid was identified on chromosome 1 and has 951 of 1085 bases (87%) identical to a *Rattus norvegicus* Kilon mRNA (gb:GENBANK-ID:AB017139|acc:AB017139.1) (E=$3.6e^{-196}$).

A disclosed NOV6 polypeptide (SEQ ID NO:14) encoded by SEQ ID NO:13 is 354 amino acid residues and is presented using the one-letter code in Table 6B. Signal P, Psort and/or Hydropathy results predict that NOV6 contains a signal peptide and is likely to be localized extracellularly with a certainty of 0.8200 and localized in the lysosome (lumen) with a certainty of 0.4990. The most likely cleavage site for a NOV6 peptide is between amino acids 33 and 34, at: CLP-AG.

TABLE 6B

| Encoded NOV6 protein sequence |
|---|
| (SEQ ID NO:14) |
| MDMMLLVQGACCSNQWLAAVLLSLCCLLPSCLPAGQSVDFPWAAVDNMMVRKGDTADLRCYLEDGASKGAWLNRSSIIFAG |
| GDKWSVDPRVSISTLNKRDYSLQIQNVDVTDDGPYTCSVQTQHTPRTMQVHLTVQVPPKIYDISNDMTVNEGTNVTLTCLA |
| TGKPEPSISWRHISPSAKPFENGQYLDIYGITRDQAGEYECSAENDVSFPDVRKVKVVVNFAPTIQEIKSGTVTPGRSGLI |
| RCEGAGVPPPAFEWYKGEKKLFNGQQGIIIQNFSTRSILTVTNVTQEHFGNYTCVAANKLGTTNASLPLNPPSTAQYGITG |
| SADVLFSCWYLVLTLSSFTSIFYLKNAILQ |

The NOV6 amino acid sequence has 333 of 352 amino acid residues (94%) identical to, and 340 of 352 amino acid residues (96%) similar to, a *Rattus norvegicus* 348 amino acid residue Kilon protein precursor (kindred of iglon) (ptnr:SWISSPROT-ACC:Q9Z0J8) (E=$7.6e^{-181}$).

NOV6 is expressed in at least the following tissues: brain, retina and hair follicles. This information was derived by determining the tissue sources of the sequences that were included in the invention including but not limited to SeqCalling sources, Public EST sources, Literature sources, and/or RACE sources. In addition, NOV6 is predicted to be expressed in brain tissues because of the expression pattern of a closely related *Rattus norvegicus* Kilon mRNA homolog (GENBANK-ID: gb:GENBANK-ID:AB017139|acc:AB017139.1).

Possible small nucleotide polymorphisms (SNPs) found for NOV6 are listed in Table 6C.

TABLE 6C

SNPs

| Variant | Nucleotide Position | Base Change | Amino Acid Position | Base Change |
|---|---|---|---|---|
| 13376475 | 79 | C > T | Silent | N/A |
| 13376474 | 330 | T > C | 105 | Ile > Thr |
| 13376473 | 336 | A > G | 107 | Asn > Ser |

TABLE 6C-continued

SNPs

| Variant | Nucleotide Position | Base Change | Amino Acid Position | Base Change |
|---|---|---|---|---|
| 13376472 | 472 | A > G | Silent | N/A |
| 13376471 | 764 | G > A | 250 | Val > Met |

NOV6 also has homology to the amino acid sequences shown in the BLASTP data listed in Table 6D.

TABLE 6D

BLAST results for NOV6

| Gene Index/ Identifier | Protein/Organism | Length (aa) | Identity (%) | Positives (%) | Expect |
|---|---|---|---|---|---|
| gi\|11067409\|ref\| NP_067714.1\| (NM_021682) | Kilon [*Rattus norvegicus*] | 348 | 319/352 (90%) | 326/352 (91%) | 0.0 |
| gi\|5019445\|emb\| CAB44446.1\| (AJ132999) | neurotractin-L [*Gallus gallus*] | 352 | 276/351 (78%) | 302/351 (85%) | e−162 |
| gi\|5019443\|emb\| CAB44445.1\| (AJ132998) | neurotractin-S [*Gallus gallus*] | 261 | 169/226 (74%) | 185/226 (81%) | 2e−94 |
| gi\|2497324\|sp\| Q62813\|LAMP_RAT | LIMBIC SYSTEM-ASSOCIATED MEMBRANE PROTEIN PRECURSOR (LSAMP) [*Rattus norvegicus*] | 338 | 172/305 (56%) | 220/305 (71%) | 3e−91 |
| gi\|4505025\|ref\| NP_002329.1\| (NM_002338) | limbic system-associated membrane protein [*Homo sapiens*] | 338 | 170/291 (58%) | 216/291 (73%) | 4e−90 |

The homology of these sequences is shown graphically in the ClustalW analysis shown in Table 6E.

Table 6E Information for the ClustalW proteins

1) NOV6 (SEQ ID NO:14)
2) gi|11067409|ref|NP_067714.1| (NM_021682) Kilon [Rattus norvegicus] (SEQ ID NO:88)
3) gi|5019445|emb|CAB44446.1| (AJ132999) neurotractin-L [Gallus gallus] (SEQ ID NO:89)
4) gi|5019443|emb|CAB44445.1| (AJ132998) neurotractin-S [Gallus gallus] (SEQ ID NO:90)
5) gi|2497324|sp|Q62813|LAMP_RAT LIMBIC SYSTEM-ASSOCIATED MEMBRANE PROTEIN PRECURSOR (LSAMP) [Rattus norvegicus] (SEQ ID NO:91)
6) gi|4505025|ref|NP_002329.1| (NM_002338) limbic system-associated membrane protein [Homo sapiens] (SEQ ID NO:92)

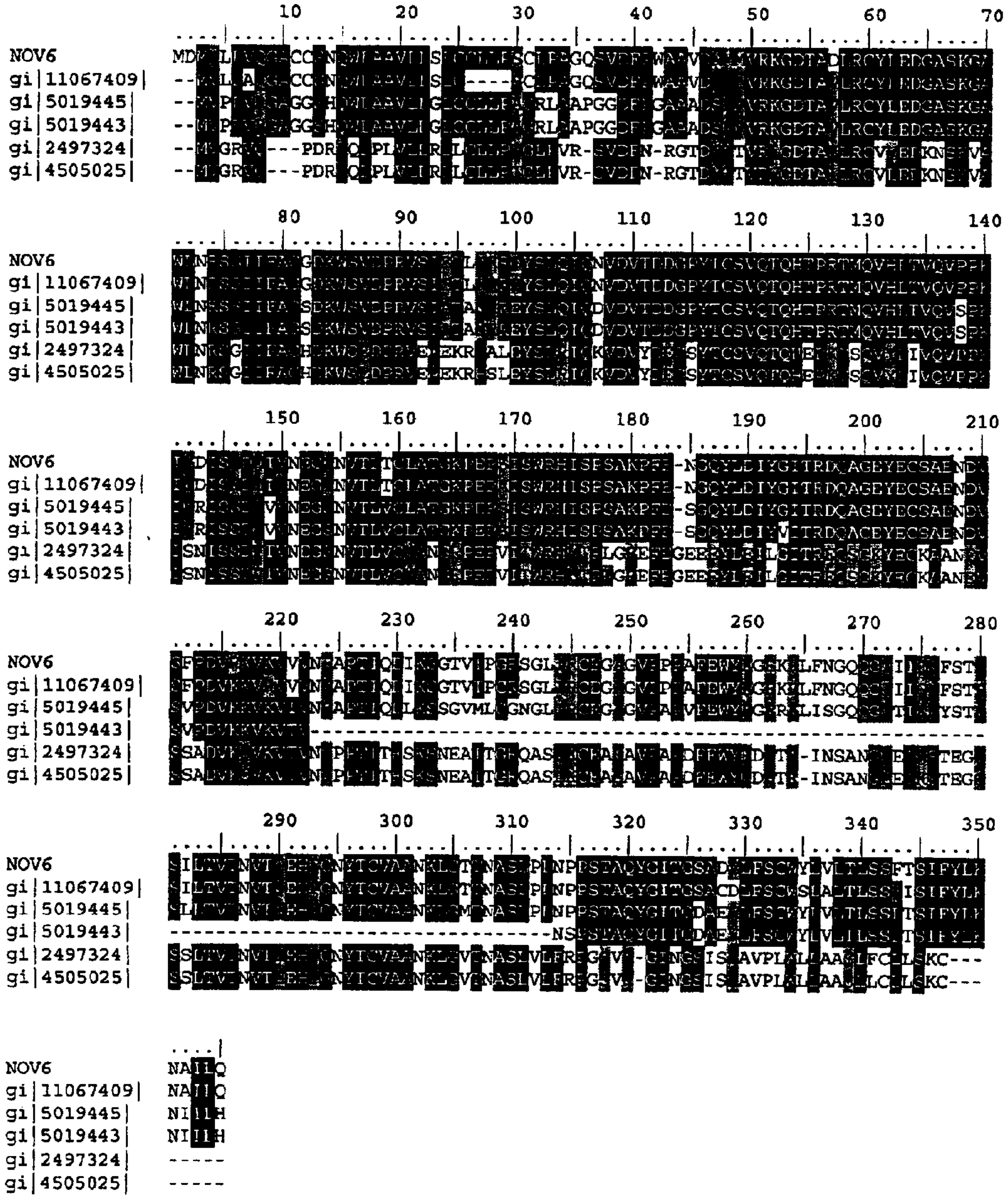

Tables 6F and 6G list the domain description from DOMAIN analysis results against NOV6. This indicates that the NOV6 sequence has properties similar to those of other proteins known to contain these domains.

TABLE 6F

Domain Analysis of NOV6

```
gnl Smart|smart00409, IG, Immunoglobulin (SEQ ID NO:93)
Length = 86 residues, 95.3% aligned
Score = 61.2 bits (147), Expect = 9e-11
NOV6:   231 KSGTVTPGRSGLIRCEGAGVPPPAFEWYKGEKKLFNGQQGIIIQNFSTRSILTVTNVTQE   290
             | ||  | |  + || +| |||   |||   ||        +      | ||++||| |
00409:    2 PSVTVKEGESVTLSCEASGNPPPTVTWYKQGGKLLAESGRFSVSRSGGNSTLTISNVTPE    61

NOV6:   291 HFGNYTCVAANKLGTTNASLPL                                        312
              | ||| | |  |+ ++   |
00409:   62 DSGTYTCAATNSSGSASSGTTL                                         83
```

TABLE 6G

Domain Analysis of NOV6

```
gnl Smart|smart00408, IGc2, Immunoglobulin C-2 Type (SEQ ID NO:94)
Length = 63 residues, 100.0% aligned
Score = 60.5 bits (145), Expect = 2e-10
NOV6:   151 NEGTNVTLTCLATGKPEPSISWRHIS---PSAKPFENGQYLDIYGITRDQAGEYECSAEN   207
             || +||||| |+| | |+|+|       | ++  +|  | |  ++ + +| | | | |
00408:    1 LEGESVTLTCPASGDPVPNITWLKDGKPLPESRVVASGSTLTIKNVSLEDSGLYTCVARN    60

NOV6:   208 DVS                                                           210
             |
00408:   61 SVG                                                            63
```

The NOV6 gene encodes for a protein that has high homology to the IgLON adhesion molecules. This is a subfamily of the immunoglobulin superfamily that comprises of proteins such as LAMP, OBCAM and neurotrimin. These proteins are proteins anchored by a glycosyphosphatidylinositol anchor that are involved in cell adhesion and participate in remodeling of neurons. The NOV6 gene shows the presence of three immunoglobulin domains that participate in protein-protein interactions and are the hallmark of this family of proteins.

In the central nervous system, many cell adhesion molecules are known to participate in the establishment and remodeling of the neural circuit. Some of the cell adhesion molecules are known to be anchored to the membrane by the glycosylphosphatidylinositol (GPI) inserted to their C termini, and many GPI-anchored proteins are known to be localized in a Triton-insoluble membrane fraction of low density or so-called "raft." In a study, the GPI-anchored proteins were surveyed in the Triton-insoluble low density fraction from 2-week-old rat brain by solubilization with phosphatidylinositol-specific phospholipase C. By Western blotting and partial peptide sequencing after the deglycosylation with peptide N-glycosidase F, the presence of Thy-1, F3/contactin, and T-cadherin was shown. In addition, one of the major proteins, having an apparent molecular mass of 36 kDa after the peptide N-glycosidase F digestion, was found to be a novel protein. The result of cDNA cloning showed that the protein is an immunoglobulin superfamily member with three C2 domains and has six putative glycosylation sites. Since this protein shows high sequence similarity to IgLON family members including LAMP, OBCAM, neurotrimin, CEPU-1, AvGP50, and GP55, we termed the protein Kilon (a kindred of IgLON). Kilon-specific monoclonal antibodies were produced, and Western blotting analysis showed that expression of Kilon is restricted to brain, and Kilon has an apparent molecular mass of 46 kDa in SDS-polyacrylamide gel electrophoresis in its expressed form. In brain, the expression of Kilon is already detected in E16 stage, and its level gradually increases during development. Kilon immunostaining was observed in the cerebral cortex and hippocampus, in which the strongly stained puncta were observed on dendrites and soma of pyramidal neurons (Funatsu et al., Characterization of a novel rat brain glycosylphosphatidylinositol-anchored protein (Kilon), a member of the IgLON cell adhesion molecule family. J Biol Chem 274(12):8224–30, 1999).

The formation of axon tracts in nervous system histogenesis is the result of selective axon fasciculation and specific growth cone guidance in embryonic development. One group of proteins implicated in neurite outgrowth, fasciculation, and guidance is the neural members of the Ig superfamily (IgSF). In an attempt to identify and characterize new proteins of this superfamily in the developing nervous system, a PCR-based strategy was used with degenerated primers that represent conserved sequences around the characteristic cysteine residues of Ig-like domains. Using this approach, a novel neural IgSF member was identified, termed neurotractin. This GPI-linked cell surface glycoprotein is composed of three Ig-like domains and belongs to the IgLON subgroup of neural IgSF members. It is expressed in two isoforms with apparent molecular masses of 50 and 37 kD, termed L-form and S-form, respectively. Monoclonal antibodies were used to analyze its biochemical features and histological distribution. Neurotractin is restricted to subsets of developing commissural and longitudinal axon tracts in the chick central nervous system. Recombinant neurotractin promotes neurite outgrowth of telencephalic neurons and interacts with the IgSF members CEPU-1 (KD=3×10(−8)M) and LAMP. Data suggest that neurotractin participates in the regulation of neurite outgrowth in the developing brain (Marg et al., Neurotractin, a novel neurite outgrowth-pro moting Ig-like protein that interacts with CEPU-1 and LAMP. J Cell Biol 145(4):865–76, 1999).

The above defined information for NOV6 suggests that NOV6 may function as a member of a KILON protein family. Therefore, the NOV6 nucleic acids and proteins of the invention are useful in potential therapeutic applications implicated in various diseases and disorders described below and/or other pathologies. For example, the NOV6 compositions of the present invention will have efficacy for treatment of patients suffering from Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, diabetes, psoriasis, actinic keratosis, acne, hair growth/loss, allopecia, pigmentation disorders, endocrine disorders, cancer, trauma and/or viral/bacterial/parasitic infections. They may also be used for cell or tissue regeneration (in vitro or in vivo). The NOV6 nucleic acid encoding KILON-like protein, and the KILON-like protein of the invention, or fragments thereof, may further be useful in diagnostic applications, wherein the presence or amount of the nucleic acid or the protein are to be assessed.

NOV7

A disclosed NOV7 nucleic acid of 3092 nucleotides (also referred to CG56071-01) encoding a novel mixed lineage kinase 2-like protein is shown in Table 7A. An open reading frame was identified beginning with an ATG initiation codon at nucleotides 1–3 and ending with a TAG codon at nucleotides 3073–3075. A putative untranslated region downstream from the termination codon is underlined in Table 7A, and the start and stop codons are in bold letters.

TABLE 7A

| NOV7 Nucleotide Sequence |
| --- |
| (SEQ ID NO:15) |
| **ATG**GAGCCCTCCAGAGCGCTTCTCGGCTGCCTAGCGAGCGCCGCCGCTGCCGCCCCGCCGGGGGAGGATGGAGCAGGGGC |
| CGGGGCCGAGGAGGAGGAGGAGGAGGAGGAGGAGGCGGCGGCGGCGGTGGGCCCCGGGGAGCTGGGCTGCGACGCGCCGC |
| TGCCCTACTGGACGGCCGTGTTCGAGTACGAGGCGGCGGGCGAGGACGAGCTGACCCTGCGGCTGGGCGACGTGGTGGAG |
| GTGCTGTCCAAGGACTCGCAGGTGTCCGGCGACGACGGCTGGTGGACCGGGCAGCTGAACCAGCGGGTGGGCATCTTCCC |
| CAGCAACTACGTGACCCCGCGCAGCGCCTTCTCCAGCCGCTGCCAGCCCGGCGGCGAAATTGATTTTGCGGAGCTCACCT |
| TGGAAGAGATTATTGGCATCGGGGGCTTTGGGAAGGTCTATCGTGCTTTCTGGATAGGGGATGAGGTTGCTGTGAAAGCA |
| GCTCGCCACGACCCTGATGAGGACATCAGCCAGACCATAGAGAATGTTCGCCAAGAGGCCAAGCTCTTCGCCATGCTGAA |
| GCACCCCAACATCATTGCCCTAAGAGGGGTATGTCTGAAGGAGCCCAACCTCTGCTTGGTCATGGAGTTTGCTCGTGGAG |
| GACCTTTGAATAGAGTGTTATCTGGGAAAAGGATTCCCCCAGACATCCTGGTGAATTGGGCTGTGCAGATTGCCAGAGGG |
| ATGAACTACTTACATGATGAGGCAATTGTTCCCATCATCCACCGCGACCTTAAGTCCAGCAACGTATTGATCCTCCAGAA |
| GGTGGAGAATGGAGACCTGAGCAACAAGATTCTGAAGATCACTGATTTTGGCCTGGCTCGGGAATGGCACCGAACCACCA |
| AGATGAGTGCGGCAGGGACGTATGCTTGGATGGCACCCGAAGTCATCCGGGCCTCCATGTTTTCCAAAGGCAGTGATGTG |
| TGGAGCTATGGGGTGCTACTTTGGGAGTTGCTGACTGGTGAGGTGCCCTTTCGAGGCATTGATGGCTTAGCAGTCGCTTA |
| TGGAGTGGCCATGAACAAACTCGCCCTTCCTATTCCTTCTACGTGCCCAGAACCTTTTGCCAAACTCATGGAAGACTGCT |
| GGAATCCTGATCCCCACTCACGACCATCTTTCACGAATATCCTGGACCAGCTAACCACCATAGAGGAGTCTGGTTTCTTT |
| GAAATGCCCAAGGACTCCTTCCACTGCCTGCAGGACAACTGGAAACACGAGATTCAGGAGATGTTTGACCAACTCAGGGC |
| CAAAGAAAAGGAACTTCGCACCTGGGAGGAGGAGCTGACGCGGGCTGCACTGCAGCAGAAGAACCAGGAGGAACTGCTGC |
| GGCGTCGGGAGCAGGAGCTGGCCGAGCGGGAGATTGACATCCTGGAACGGGAGCTCAACATCATCATCCACCAGCTGTGC |
| CAGGAGAAGCCCCGGGTGAAGAAACGCAAGGGCAAGTTCAGGAAGAGCCGGCTGAAGCTCAAGGATGGCAACCGCATCAG |
| CCTCCCTTCTGGTTTCCAGCACAAGTTCACGGTGCAGGCCTCCCCTACCATGGATAAAAGGAAGAGTCTTATCAACAGCC |
| GCTCCAGTCCTCCTGCAAGCCCCACCATCATTCCTCGCCTTCGAGCCATCCAGTGTGAGACTGTTTCCCAAATTAGCTGG |
| GGCCAGAACACACAGGGGCACCTGTCCGAAAGCAGCAAAACCTGGGGCAGGAGCTCAGTCGTCCCAAAGGAGGAAGGGGA |
| GGAGGAGGAGAAGAGGGCCCCAAAGAAGAAGGGACGGACGTGGGGGCCAGGGACGCTTGGTCAGAAGGAGCTTGCCTCGG |
| GAGATGAACTCAAGTCCCTGGTAGATGGATATAAGCAGTGGTCGTCCAGTGCCCCCAACCTGGTGAAGGGCCCAAGGAGT |
| ACCCCGGCCCTGCCAGGGTTCACCAGCCTTATGGAGATGGAGGATGAGGACAGTGAAGGCCCAGGGAGTGGAGAGAGTCG |
| CCTACAGCATTCACCCAGCCAGTCCTACCTCTGTATCCCATTCCCTCGTGGAGAGCCCACCCCAGTCAACTCGGCCACGA |
| GTACCCCTCAGCTGACGCCAACCAACAGCCTCAAGCGGGGCGGTGCCCACCACCGCCGCTGCGAGGTGGCTCTGCTCGGC |

TABLE 7A-continued

| NOV7 Nucleotide Sequence |
|---|
| TGTGGGGCTGTTCTGGCAGCCACAGGCCTAGGGTTTGACTTGCTGGAAGCTGGCAAGTGCCAGCTGCTTCCCCTGGAGGA |
| GCCTGAGCCACCAGCCCGGGAGGAGAAGAAAAGACGGGAGGGTCTTTTTCAGAGGTCCAGCCGTCCTCGTCGGAGCACCA |
| GCCCCCCATCCCGAAAGCTTTTCAAGAAGGAGGAGCCCATGCTGTTGCTAGGAGACCCCTCTGCCTCCCTGACGCTGCTC |
| TCCCTCTCCTCCATCTCCGAGTGCAACTCCACACGCTCCCTGCTGCAGTCCGACAGCGATGAAATTGTCGTGTATGAGAT |
| GCCAGTCAGCCCAGTCGAGGCCCCTCCCCTGAGTCCATGTACCCACAACCCCCTGGTCAATGTCCGAGTAGAGCGCTTCA |
| AACGAGATCCTAACCAATCTCTGACTCCCACCCATGTCACCCTCACCACCCCCTCGCAGCCCAGCAGTCACCGGCGGACT |
| CCTTCTGATGGGGCCCTTAAGCCAGAGACTCTCCTAGCCAGCAGGAGCCCCAGTCCCAGCCGAGACCCAGGTGAATTCCC |
| CCGTCTCCCTGACCCCAATGTGGTCTTCCCCCCAACCCCAAGGCGCTGGAACACTCAGCAGGACTCTACCTTGGAGAGAC |
| CCAAGACTCTGGAGTTTCTGCCTCGGCCGCGTCCTTCTGCCAACCGGCAACGGCTGGACCCTTGGTGGTTTGTGTCCCCC |
| AGCCATGCCCGCAGCACCTCCCCAGCCAACAGCTCCAGCACAGAGACGCCCGGGCCGCTGCCCCCGACTGAGCGGACGCT |
| CCTGGACCTGGATGCAGAGGGGCAGAGTCAGGACAGCACCGTGCCGCTGTGCAGAGCGGAACTGAACACACACAGGCCTG |
| CCCCTTATGAGATCCAGCAGGAGTTCTGGTCT**TAG**CACGAAAAGGATTGGGG |

The disclosed NOV7 nucleic acid sequence, localized to chromosome 14q24.3, has 1460 of 2133 bases (68%) identical to a *Homo sapiens* MST serine/threonine kinase mRNA (gb:GENBANK-ID:HSMSTMR|acc:Z48615.1) (E=9.8e$^{-164}$).

A disclosed NOV7 polypeptide (SEQ ID NO:16) encoded by SEQ ID NO:15 is 1024 amino acid residues and is presented using the one-letter amino acid code in Table 7B. Signal P, Psort and/or Hydropathy results predict that NOV7 contains a signal peptide and is likely to be localized to the plasma membrane with a certainty of 0.4600. The most likely cleavage site for a NOV7 peptide is between amino acids 17 and 18, at: AAA-AP.

The NOV7 amino acid sequence has 496 of 887 amino acid residues (55%) identical to, and 607 of 887 amino acid residues (68%) similar to the *Homo sapiens* 954 amino acid residue mitogen-activated protein kinase kinase kinase 10 (ec 2.7.1.–) (mixed lineage kinase 2) protein kinase MST) (ptnr:SWISSPROT-ACC:Q02779) (E=1.7e$^{-229}$).

NOV7 is expressed in at least the following tissues: testis, kidney, and whole organism. This information was derived by determining the tissue sources of the sequences that were included in the invention including but not limited to SeqCalling sources, Public EST sources, Literature sources, and/or RACE sources. In addition, NOV7 is predicted to be expressed in various tissues because of the expression

TABLE 7B

| Encoded NOV7 protein sequence. |
|---|
| (SEQ ID NO:16) |
| MEPSRALLGCLASAAAAAPPGEDGAGAGAEEEEEEEEEAAAAVGPGELGCDAPLPYWTAVFEYEAAGEDELTLRLGDVVE |
| VLSKDSQVSGDEGWWTGQLNQRVGIFPSNYVTPRSAFSSRCQPGGEIDFAELTLEEIIGIGGFGKVYRAFWIGDEVAVKA |
| ARHDPDEDISQTIENVRQEAKLFAMLKHPNIIALRGVCLKEPNLCLVMEFARGGPLNRVLSGKRIPPDILVNWAVQIARG |
| MNYLHDEAIVPIIHRDLKSSNVLILQKVENGDLSNKILKITDFGLAREWHRTTKMSAAGTYAWMAPEVIRASMFSKGSDV |
| WSYGVLLWELLTGEVPFRGIDGLAVAYGVAMNKLALPIPSTCPEPFAKLMEDCWNPDPHSRPSFTNILDQLTTIEESGFF |
| EMPKDSFHCLQDNWKHEIQEMFDQLRAKEKELRTWEEELTRAALQQKNQEELLRRREQELAEREIDILERELNIIIHQLC |
| QEKPRVKKRKGKFRKSRLKLKDGNRISLPSGFQHKFTVQASPTMDKRKSLINSRSSPPASPTIIPRLRAIQCETVSQISW |
| GQNTQGHLSESSKTWGRSSVVPKEEGEEEEKRAPKKKGRTWGPGTLGQKELASGDELKSLVDGYKQWSSSAPNLVKGPRS |
| TPALPGFTSLMEMEDEDSEGPGSGESRLQHSPSQSYLCIPFPRGEPTPVNSATSTPQLTPTNSLKRGGAHHRRCEVALLG |
| CGAVLAATGLGFDLLEAGKCQLLPLEEPEPPAREEKKRREGLFQRSSRPRRSTSPPSRKLFKKEEPMLLLGDPSASLTLL |
| SLSSISECNSTRSLLQSDSDEIVVYEMPVSPVEAPPLSPCTHNPLVNVRVERFKRDPNQSLTPTHVTLTTPSQPSSHRRT |
| PSDGALKPETLLASRSPSPSRDPGEFPRLPDPNVVFPPTPRRWNTQQDSTLERPKTLEFLPRPRPSANRQRLDPWWFVSP |
| SHARSTSPANSSSTETPGPLPPTERTLLDLDAEGQSQDSTVPLCRAELNTHRPAPYEIQQEFWS |

pattern of a closely related *Homo sapiens* MST serine/threonine kinase mRNA homolog (gb:GENBANK-ID:HSMSTMR|acc:Z48615.1.

Possible small nucleotide polymorphisms (SNPs) found for NOV7 are listed in Table 7C.

TABLE 7C

SNPs

| Variant | Nucleotide Position | Base Change | Amino Acid Position | Base Change |
|---|---|---|---|---|
| 13376557 | 373 | C > T | Silent | N/A |
| 13376556 | 415 | C > T | Silent | N/A |
| 13374149 | 578 | G > A | 122 | Gly > Arg |
| 13376555 | 588 | A > G | 125 | Glu > Gly |
| 13376554 | 716 | C > T | 168 | Pro > Ser |

TABLE 7C-continued

SNPs

| Variant | Nucleotide Position | Base Change | Amino Acid Position | Base Change |
|---|---|---|---|---|
| 13376553 | 753 | A > G | 180 | Gln > Arg |
| 13376552 | 819 | C > T | 202 | Thr > Ile |

NOV7 has homology to the amino acid sequence shown in the BLASTP data listed in Table 7D.

TABLE 7D

BLAST results for NOV7

| Gene Index/ Identifier | Protein/Organism | Length (aa) | Identity (%) | Positives (%) | Expect |
|---|---|---|---|---|---|
| gi\|12005724\|gb\|AAG44591.1\|AF251442_1 (AF251442) | mixed lineage kinase MLK1 [*Homo sapiens*] | 1066 | 834/1080 (77%) | 837/1080 (77%) | 0.0 |
| gi\|14749517\|ref\|XP_027237.1\| (XM_027237) | mitogen-activated protein kinase kinase kinase 9 [*Homo sapiens*] | 922 | 702/936 (75%) | 705/936 (75%) | 0.0 |
| gi\|6686295\|sp\|Q02779\|M3KA_HUMAN | MITOGEN-ACTIVATED PROTEIN KINASE KINASE KINASE 10 (MIXED LINEAGE KINASE 2) (PROTEIN KINASE MST) [*Homo sapiens*] | 954 | 506/965 (52%) | 607/965 (62%) | 0.0 |
| gi\|4505263\|ref\|NP_002437.1\| (NM_002446) | mitogen-activated protein kinase kinase kinase 10; mixed lineage kinase 2 (tyr and ser/thr specificity); MKN28 kinase [*Homo sapiens*] | 953 | 504/964 (52%) | 606/964 (62%) | 0.0 |
| gi\|462606\|sp\|P80192\|M3K9_HUMAN | MITOGEN-ACTIVATED PROTEIN KINASE KINASE KINASE 9 (MIXED LINEAGE KINASE 1) [*Homo sapiens*] | 394 | 346/369 (93%) | 347/369 (93%) | 0.0 |

The homology of these sequences is shown graphically in the ClustalW analysis shown in Table 7E.

Table 7E. Information for the ClustalW proteins

1) NOV7 (SEQ ID NO:16)
2) gi|12005724|gb|AAG44591.1|AF251442_1 (AF251442) mixed lineage kinase MLK1 [Homo sapiens] (SEQ ID NO:95)

3) gi 14749517|ref|XP_027237.1| (XM_027237) mitogen-activated protein kinase kinase kinase 9 [Homo sapiens] (SEQ ID NO:96)

4) gi 6686295|sp|Q02779|M3KA_HUMAN MITOGEN-ACTIVATED PROTEIN KINASE KINASE KINASE 10 (MIXED LINEAGE KINASE 2) (PROTEIN KINASE MST) [Homo sapiens] (SEQ ID NO:97)

5) gi 4505263|ref|NP_002437.1| (NM_002446) mitogen-activated protein kinase kinase kinase 10; mixed lineage kinase 2 (tyr and ser/thr specificity); MKN28 kinase [Homo sapiens] (SEQ ID NO:98)

6) gi 462606|sp|P80192|M3K9_HUMAN MITOGEN-ACTIVATED PROTEIN KINASE KINASE KINASE 9 (MIXED LINEAGE KINASE 1) [Homo sapiens] (SEQ ID NO:99)

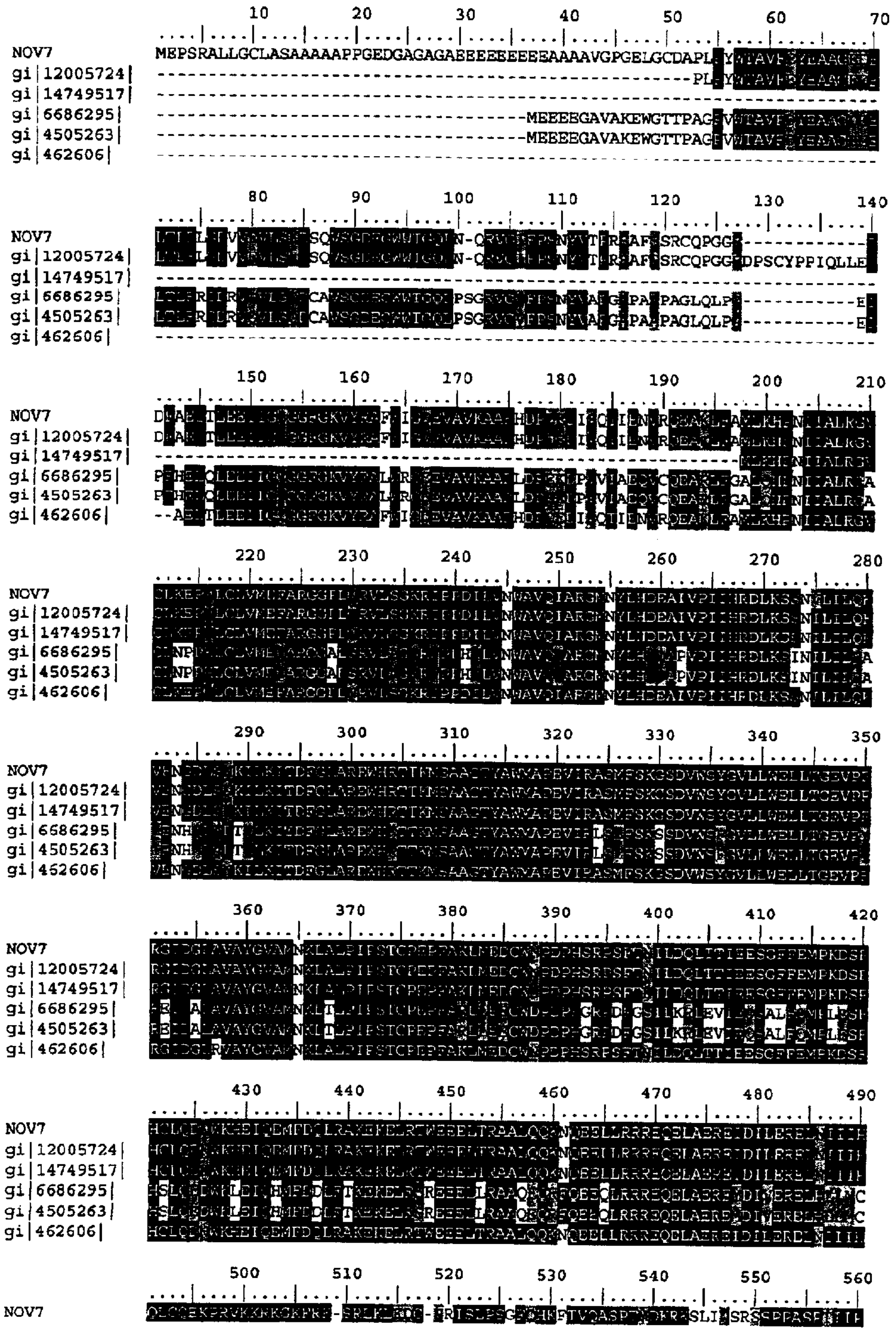

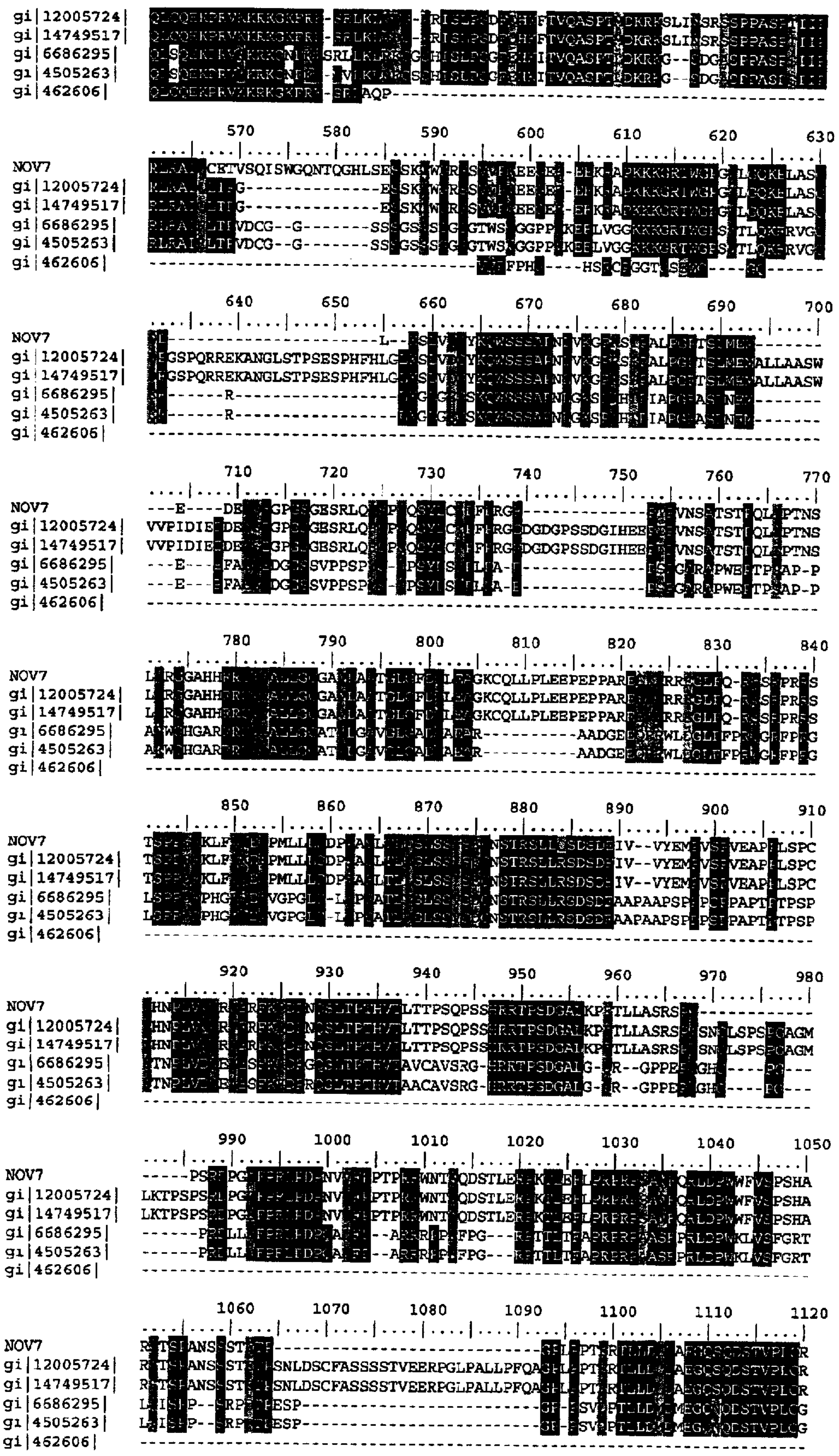
NOV7
gi|12005724|
gi|14749517|
gi|6686295|
gi|4505263|
gi|462606|
570 580 590 600 610 620 630
640 650 660 670 680 690 700
710 720 730 740 750 760 770
780 790 800 810 820 830 840
850 860 870 880 890 900 910
920 930 940 950 960 970 980
990 1000 1010 1020 1030 1040 1050
1060 1070 1080 1090 1100 1110 1120

```
                            1130
              ....|....|....|....
NOV7          [illegible]ELN[illegible][illegible]RPAPYEIQQEFWS
gi|12005724|  [illegible]ELN[illegible][illegible]RPAPYEIQQEFWS
gi|14749517|  [illegible]ELN[illegible][illegible]RPAPYEIQQEFWS
gi|6686295|   [illegible]HG-[illegible][illegible]-------------
gi|4505263|   [illegible]HG-[illegible][illegible]-------------
gi|462606|    -------------------
```

Tables 7F–7J list the domain description from DOMAIN analysis results against NOV7. This indicates that the NOV7 sequence has properties similar to those of other proteins known to contain these domains.

TABLE 7F

Domain Analysis of NOV7

```
gnl Smart|smart00219, TyrKc, Tyrosine kinase, catalytic domain;
Phosphotransferases. Tyrosine-specific kinase subfamily. (SEQ ID NO:100)
Length = 258 residues, 100.0% aligned
Score = 260 bits (665), Expect = 2e-70
NOV7:   132 LTLEEIIGIGGFGKVYRAFWIGD-----EVAVKAARHDPDEDISQTIENVRQEAKLFAML  186
            ||| + +| | ||+||+    |      |||||  + |  |   | ||   +||+|   |
00219:    1 LTLGKKLGEGAFGEVYKGTLKGKGGVEVEVAVKTLKEDASE---QQIEEFLREARLMRKL   57

NOV7:   187 KHPNIIALRGVCLKEPNLCLVMEFARGGPLNRVL---SGKRIPPDILVNWAVQIARGMNY  243
             ||||+ | ||| +|  | +|||+  || |   |     | +    |+++|+|||||| |
00219:   58 DHPNIVKLLGVCTEEEPLMIVMEYMEGGDLLDYLRKNRPKELSLSDLLSFALQIARGMEY  117

NOV7:   244 LHDEAIVPIIHRDLKSSNVLILQKVENGDLSNKILKITDFGLAREWHRTTKMSAAGT---  300
            |        +|||| + | |+          || +|| ||||||+ +         +
00219:  118 LES---KNFVHRDLAARNCLV--------GENKTVKIADFGLARDLYDDDYYRKKKSPRL  166

NOV7:   301 -YAWMAPEVIRASMFSKGSDVWSYGVLLWELLT-GEVPFRGIDGLAVAYGVAMNKLALPI  358
               ||||| ++   |+  |||||+||||||+ | || |+ |+    |   +      ||
00219:  167 PIRWMAPESLKDGKFTSKSDVWSFGVLLWEIFTLGESPYPGMSNEEVLEYL-KKGYRLPQ  225

NOV7:   359 PSTCPEPFAKLMEDCWNPDPHSRPSFTNILDQL                             391
            |  ||+    ||  ||  ||  ||+|+ ++++|
00219:  226 PPNCPDEIYDLMLQCWAEDPEDRPTFSELVERL                             258
```

TABLE 7G

Domain Analysis of NOV7

```
gnl Pfam pfam00069, pkinase, Protein kinase domain. (SEQ ID NO:101)
Length = 256 residues, 98.0% aligned
Score = 255 bits (652), Expect = 8e-69
NOV7:   132 LTLEEIIGIGGFGKVYRAFWI--GDEVAVKAARHDPDEDISQTIENVRQEAKLFAMLKHP  189
              | | +| | |||||+      |+ ||+|  +      +|+  +   +| ++   | ||
00069:    1 YELGEKLGSGAFGKVYKGKHKDTGEIVAIKILK---KRSLSEKKKRFLREIQILRRLSHP   57

NOV7:   190 NIIALRGVCLKEPNLCLVMEFARGGPLNRVLSGKR--IPPDILVNWAVQIARGMNYLHDE  247
            ||+ | ||  ++ +| ||||+  || |   |      +        |+|| ||+ |||
00069:   58 NIVRLLGVFEEDDHLYLVMEYMEGGDLFDYLRRNGLLLSEKEAKKIALQILRGLEYLHSR  117

NOV7:   248 AIVPIIHRDLKSSNVLILQKVENGDLSNKILKITDFGLAREWHR---TTKMSAAGTYAWM  304
             ||   |||||  |+|+    ||| +     || ||||||+          +  ||  +|
00069:  118 GIV---HRDLKPENILL---DENGTV-----KIADFGLARKLESSSYEKLTTFVGTPEYM  166

NOV7:   305 APEVIRASMFSKGSDVWSYGVLLWELLTGEVPFRGIDGL-AVAYGVAMNKLALPIPSTCP  363
            ||||+    +|   |||| ||+|+|||||++|| ||| |  +       +| ||+|  |
00069:  167 APEVLEGRGYSSKVDVWSLGVILYELLTGKLPFPGIDPLEELFRIKERPRLRLPLPPNCS  226

NOV7:   364 EPFAKLMEDCWNPDPHSRPSFTNIL                                     388
            |    |++ | | ||  ||+   ||
00069:  227 EELKDLIKKCLNKDPEKRPTAKEIL                                     251
```

TABLE 7H

Domain Analysis of NOV7

```
gnl:Smart|smart00220, S_TKc, Serine/Threonine protein kinases,
catalytic domain; Phosphotransferases. Serine or threonine-specific
kinase subfamily. (SEQ ID NO:102)
Length = 256 residues, 97.7% aligned
Score = 221 bits (562), Expect = 2e-58
NOV7:   133 TLEEIIGIGGFGKVYRAFWI--GDEVAVKAARHDPDEDISQTIENVRQEAKLFAMLKHPN  190
             | |++| | ||||| |     |  ||+|      ++   +  | + +| |+   | |||
00220:    2 ELLEVLGKGAFGKVYLARDKKTGKLVAIK--VIKKEKLKKKKRERILREIKILKKLDHPN   59

NOV7:   191 IIALRGVCLKEPNLCLVMEFARGGPLNRVL-SGKRIPPDILVNWAVQIARGMNYLHDEAI  249
            |+ |  |   +  | ||||+  || |  +|    |+  |    +| ||   + ||| +
00220:   60 IVKLYDVFEDDDKLYLVMEYCEGGDLFDLLKKRGRLSEDEARFYARQILSALEYLHSQG-  118
```

TABLE 7H-continued

Domain Analysis of NOV7

```
NOV7:    250 VPIIHRDLKSSNVLILQKVENGDLSNKILKITDFGLAREWHRTTKM--SAAGTYAWMAPE  307
               |||||||  |+|+          |+  +|+ ||||++      +  +  ||  +||||
00220    119 --IIHRDLKPENILL--------DSDGHVKLADFGLAKQLDSGGTLLTTFVGTPEYMAPE  168

NOV7:    308 VIRASMFSKGSDVWSYGVLLWELLTGEVPFRGIDGLAVAYGVAMNKLALPIP--STCPEP  365
             |+    +  |   |+||  ||+|+||||+ ||  |  |  |     +            |
00220:   169 VLLGKGYGVAVDIWSLGVILYELLTGKPPFPGDDQLLALFKKIGKPPPPFPPPEWKISPE  228

NOV7:    366 FAKLMEDCWNPDPHSRPSFTNIL                                       388
                |++      ||   | +    |
00220:   229 AKDLIKKLLVKDPEKRLTAEEAL                                       251
```

TABLE 7I

Domain Analysis of NOV7 gnl,Smart|smart00236, SH3, Src homology 3 domains; Src homology 3 (SH3) domains bind to target proteins through sequences containing proline and hydrophobic amino acids. Pro-containing polypeptides may bind to SH3 domains in 2 different binding orientations. (SEQ ID NO:103)
Length = 59 residues, 96.6% aligned
Score = 72.0 bits (175), Expect = 2e-13

```
NOV7:     53 PLPYWTAVFEYEAAGEDELTLRLGDVVEVLSKDSQVSGDEGWWTGQL-NQRVGIFPSNYV  111
                |    |+++|  |    |||+ + ||++ ||  |        |+|||  |+|    +  |+||||||
00326:     1 EGPQVRALYDYTAQDPDELSFKKGDIITVLEKS-----DDGWWKGRLGTGKEGLFPSNYV   55

NOV7:    112 TP                                                            113
00326:    56 EE                                                             57
```

TABLE 7J

Domain Analysis of NOV7 gnl Pfam pfam0018, SH3, SH3 domain. SH3 (Src homology 3) domains are often indicative of a protein involved in signal transduction related to cytoskeletal organization. First described in the Src cytoplasmic tyrosine kinase. The structure is a partly opened beta barrel. (SEQ ID NO:104)
Length = 57 residues, 98.2% aligned
Score = 65.1 bits (157), Expect = 2e-11

```
NOV7:     55 PYWTAVFEYEAAGEDELTLRLGDVVEVLSKDSQVSGDEGWWTGQL-NQRVGIFPSNYVTP  113
             |    |+++|+|    |||+ + ||++ ||  |      |  |  |||  |+|    +  |+  |||||  |
00018:     1 PKVVALYDYQARESDELSFKKGDIIIVLEK----SDDGGWWKGRLKGTKEGLIPSNYVEP   56
```

Eukaryotic protein kinases make up a large superfamily of proteins which share a conserved catalytic core common with both serine/threonine and tyrosine protein kinases. Kinases play a central role in gene regulation and signal transduction pathways that regulate cell proliferation, differentiation and survival (Hunter and Hanks Protein kinases 6. The eukaryotic protein kinase superfamily: kinase (catalytic) domain structure and classification. FASEB J 9:576–96, 1995). SH3 (src Homology-3) domains are found in a great variety of intracellular or membrane-associated proteins and are small protein modules containing approximately 50 amino acid residues. The SH3 domain may mediate assembly of specific protein complexes and are thought to be involved in linking signals transmitted from the cell surface by protein tyrosine kinases to "downstream effector proteins" (Baltimore and Mayer Signalling through SH2 and SH3 domains. Trends Cell Biol. 3: 8–13, 1993). The SH3 domain also regulates aspects of cell proliferation, differentiation and survival.

Two members of a novel protein kinase family, the mixed-lineage kinases (MLK) have been identified based on their expression in human epithelial tumor cells. The human mixed-lineage kinase 2 (MLK2) (also called MST kinase) protein localizes to human chromosome 19q13.2. This gene was expressed in a gastric cancer cell line and epithelial tumor cells. The MST gene encodes a novel putative non-receptor type of serine/threonine kinase with Src homology 3 (SH3) domain, two leucine zipper domains and proline rich domain. The role of this gene in cancer has not yet been clearly defined but its expression suggests an important role in disease processes. The novel gene described in this invention is similar to MLK2, localizes to chromosome 14 and may play an important role in autoimmune, metabolic and neurological diseases as well as cancer (Dorow et al., Complete nucleotide sequence, expression, and chromosomal localisation of human mixed-lineage kinase 2. Eur J Biochem 234: 492–500, 1995; Katoh et al., Cloning and characterization of MST, a novel (putative) serine/threonine kinase with SH3 domain. Oncogene 10: 1447–51, 1995).

The above defined information for NOV7 suggests that this NOV7 protein may function as a member of a mixed lineage kinase 2- protein family. Therefore, the NOV7 nucleic acids and proteins of the invention are useful in potential therapeutic applications implicated in various diseases and disorders described below and/or other pathologies. For example, the NOV7 compositions of the present invention will have efficacy for treatment of patients suffering from diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, fertility, cancer, trauma, regeneration (in vivo and in vitro), bacterial and/or viral infections. The NOV7 nucleic acid encoding mixed lineage kinase 2-like protein, and the mixed lineage kinase 2-like protein of the invention, or fragments thereof, may further be useful in diagnostic applications, wherein the presence or amount of the nucleic acid or the protein are to be assessed.

NOV8

A disclosed NOV8 nucleic acid of 834 nucleotides (also referred to CG56042-01) encoding a novel S-1-like protein is shown in Table 8A. An open reading frame was identified beginning with an ATG initiation codon at nucleotides 215–217 and ending with a TGA codon at nucleotides 827–829. Putitive untranslated regions upstream from the initiation codon and downstream from the termination codon are underlined in Table 8A, and the start and stop codons are in bold letters.

TABLE 8A

| NOV8 Nucleotide Sequence |
|---|
| (SEQ ID NO:17) |
| ATGACATGGCGGGCAGTGGTCAGGATACTGACCTGGGCTGCCCTACAGGT |
| GTTGGTAAGTTGGTTATCATGCCCTCTCTCACCCCTACCACAGCTCCCCA |
| TGCCGCAATGGCGGGCAGTGCCAGGACGACCAGGGCTTTGCTCTCAACTT |
| CACGTGCCGCTGCTTGGTGGGCTTTGTGGGTGCCCGCTGTGAGGTAAATG |
| TGGATGACTGCCTG**ATG**CGGCCTTGTGCTAACGGTGCCACCTGCCTTGAC |
| GGCATAAACCGCTTCTCCTGCCTCTGTCCTGAGGGCTTTGCTGGACGCTT |
| CTGCACCATCAACCTGGATGACTGTGCCAGCCGCCCATGCCAGAGAGGGG |
| CCCGCTGTCGGGACCGTGTCCACGACTTCGACTGCCTCTGCCCCAGTGGC |
| TATGGTGGCAAGACCTGTGAGCTTGTCTTACCTGTCCCACACCCCCCAAC |
| CACAGTGGACACCCCTCTAGGGCCCACCTCAGCTGTAGTGGTACCTGCCA |
| CGGGGCCAGCCCCCCACAGCGCAGGGGCTGGTCTGCTGCGGATCTCAGTG |
| AAGGAGGTGGTGCGGAGGCAAGAGGCTGGGCTAGGTGAGCCTAGCTTGGT |
| GGCCCTGGTGGTGTTTGGGGCCCTCACTGCTGCCCTGGTTCTGGCTACTG |
| TGTTGCTGACCCTGAGGGCCTGGCGCCGGGGTGTCTGCCCCCCTGGACCC |
| TGTTGCTACCCTGCCCCACACTATGCTCCAGCGTGCCAGGACCAGGAGTG |
| TCAGGTTAGCATGCTGCCAGCAGGGCTCCCCCTGCCACGTGACTTGCCGC |
| CTGAGCCTGGAAAGACCACAGCACTG**TGA**TGGAG |

The disclosed NOV8 nucleic acid sequence has 213 of 261 bases (81%) identical to a *Mus musculus* S-1 mRNA (gb:GENBANK-ID:AB011019|acc:AB01019.1) (E=2.3e$^{-32}$).

A disclosed NOV8 polypeptide (SEQ ID NO:18) encoded by SEQ ID NO:17 is 204 amino acid residues and is presented using the one-letter amino acid code in Table 8B. Signal P, Psort and/or Hydropathy results predict that NOV8 does not contain a signal peptide and is likely to be localized at the mitochondrial inner membrane with a certainty of 0.8218 and to the plasma membrane with a certainty of 0.7000.

TABLE 8B

| Encoded NOV8 protein sequence. |
|---|
| (SEQ ID NO:18) |
| MRPCANGATCLDGINRFSCLCPEGFAGRFCTINLDDCASRPCQRGARCRD |
| RVHDFDCLCPSGYGGKTCELVLPVPDPPTTVDTPLGPTSAVVVPATGPAP |
| HSAGAGLLRISVKEVVRRQEAGLGEPSLVALVVFGALTAALVLATVLLTL |
| RAWRRGVCPPGPCCYPAPHYAPACQDQECQVSMLPAGLPLPRDLPPEPGK |
| TTAL |

The NOV8 amino acid sequence has 71 of 84 amino acid residues (84%) identical to, and 73 of 84 amino acid residues (86%) similar to, a *Mus musculus* 102 amino acid residue S-1 protein (ptnr:SPTREMBL-ACC:Q9QYP3) (E=6.4e$^{-33}$).

NOV8 is expressed in at least the following tissues: Adrenal Gland/Suprarenal gland, Brain, Kidney, Liver, Lung, Mammary gland/Breast, Pancreas, Parietal Lobe, Pituitary Gland, Prostate, Synovium/Synovial membrane, Testis, Uterus, and Whole Organism. This information was derived by determining the tissue sources of the sequences that were included in the invention including but not limited to SeqCalling sources, Public EST sources, Literature sources, and/or RACE sources.

Possible small nucleotide polymorphisms (SNPs) found for NOV8 is listed in Table 8C.

TABLE 8C

| SNPs | | | |
|---|---|---|---|
| Consensus Position | Depth | Base Change | PAF |
| 384 | 54 | C > T | 0.093 |
| 506 | 65 | A > G | 0.031 |
| 547 | 67 | G > A | 0.463 |
| 569 | 65 | G > A | 0.031 |
| 589 | 65 | G > A | 0.477 |
| 622 | 65 | G > A | 0.031 |

The disclosed NOV8 polypeptide also has homology to the amino acid sequences shown in the BLASTP data listed in Table 8D.

TABLE 8D

BLAST results for NOV8a

| Gene Index/ Identifier | Protein/Organism | Length (aa) | Identity (%) | Positives (%) | Expect |
|---|---|---|---|---|---|
| gi\|13027596\|ref\|NP_076421.1\| (NM_023932) | hypothetical protein MGC2487 [*Homo sapiens*] | 204 | 148/204 (72%) | 148/204 (72%) | 2e−63 |
| gi\|6682739\|dbj\|BAA88686.1\| (AB011019) | S-1 [*Mus musculus*] | 102 | 63/118 (53%) | 64/118 (53%) | 7e−17 |
| gi\|6681197\|ref\|NP_031891.1\| (NM_007865) | delta-like 1 (Drosophila); delta-like 1 homolog (Drosophila) [*Mus musculus*] | 722 | 38/66 (57%) | 45/66 (67%) | 3e−15 |
| gi\|14091746\|ref\|NP_114452.1\| (NM_032063) | delta (Drosophila)-like 1 [*Rattus norvegicus*] | 714 | 37/66 (56%) | 45/66 (68%) | 4e−15 |
| gi\|807696\|gb\|AAC38017.1\| (L42229) | x-Delta-1 [*Xenopus laevis*] | 721 | 38/66 (57%) | 44/66 (66%) | 5e−15 |

The homology between these and other sequences is shown graphically in the ClustalW analysis shown in Table 8E.

Table 8E. ClustalW Analysis of NOV8a

1) Novel NOV8 (SEQ ID NO:18)
2) gi|13027596|ref|NP_076421.1| (NM_023932) hypothetical protein MGC2487 [Homo sapiens] (SEQ ID NO:105)
3) gi|6682739|dbj|BAA88686.1| (AB011019) S-1 [Mus musculus] (SEQ ID NO:106)
4) gi|6681197|ref|NP_031891.1| (NM_007865) delta-like 1 (Drosophila); delta-like 1 homolog (Drosophila) [Mus musculus] (SEQ ID NO:107)
5) gi|14091746|ref|NP_114452.1| (NM_032063) delta (Drosophila)-like 1 [Rattus norvegicus] (SEQ ID NO:108)
6) gi|807696|gb|AAC38017.1| (L42229) x-Delta-1 [Xenopus laevis] (SEQ ID NO:109)

```
                        10        20        30        40        50        60        70
                ....|....|....|....|....|....|....|....|....|....|....|....|....|....|
NOV8            ----------------------------------------------------------------------
gi|13027596|    ----------------------------------------------------------------------
gi|6682739|     ----------------------------------------------------------------------
gi|6681197|     MGRRSALALAVVSALLCQVWSSGVFELKLQEFVNKKGLLGNRNCCRGG---SGPPCACRTFFRVCLKHYQ
gi|14091746|    MGRRSALALAVVSALLCQVWSSGVFELKLQEFVNKKGLLGNRNCCRGG---SGPPCACRTFFRVCLKHYQ
gi|807696|      MGQQRMLTLLVLSAVLCQISCSGLFELRLQEFVNKKGLLGNMNCCRPGSLASLQRCECKTFFRICLKHYQ

                        80        90       100       110       120       130       140
                ....|....|....|....|....|....|....|....|....|....|....|....|....|....|
NOV8            ----------------------------------------------------------------------
gi|13027596|    ----------------------------------------------------------------------
gi|6682739|     ----------------------------------------------------------------------
gi|6681197|     ASVSPEPPCTYGSAVTPVLGVDSFSLPDGAGIDPAFSNPIRFPFGFTWPGTFSLIIEALHTDSPDDLATE
gi|14091746|    ASVSPEPPCTYGSAVTAVLGVDSFSLPDGAGIDPAFSNPIRFPFGFTWPGTFSLIIEALHTDSPDDLATE
gi|807696|      SNVSPEPPCTYGGAVTPVLGTNSFVVPESSNADPTFSNPIRFPFGFTWPGTFSLIIEAIHADSADDLNTE

                       150       160       170       180       190       200       210
                ....|....|....|....|....|....|....|....|....|....|....|....|....|....|
NOV8            ----------------------------------------------------------------------
gi|13027596|    ----------------------------------------------------------------------
gi|6682739|     ----------------------------------------------------------------------
gi|6681197|     NPERLISRLTTQRHLTVGEEWSQDLHSSGRTDLRYSYRFVCDEHYYGEGCSVFCRPRDDAFGHFTCGDRG
gi|14091746|    NPERLISRLTTQRHLTVGEEWSQDLHSSGRTDLRYSYRFVCDEHYYGEGCSVFCRPRDDAFGHFTCGERG
gi|807696|      NPERLISRLATQRHLTVGEQWSQDLHSSDRTELKYSYRFVCDEYYYGEGCSDYCRPRDDAFGHFSCGEKG

                       220       230       240       250       260       270       280
                ....|....|....|....|....|....|....|....|....|....|....|....|....|....|
NOV8            ----------------------------------------------------------------------
gi|13027596|    ----------------------------------------------------------------------
gi|6682739|     ----------------------------------------------------------------------
gi|6681197|     EKMCDPGWKGQYCTDPICLPGCDDQHGYCDKPGECKCRVGWQGRYCDECIRYPGCLHGTCQQPWQCNCQE
gi|14091746|    EKMCDPGWKGQYCTDPICLPGCDDQHGYCDKPGECKCRVGWQGRYCDECIRYPGCLHGTCQQPWQCNCQE
gi|807696|      EKLCNPGWKGLYCTEPICLPGCDEHHGYCDKPGECKCRVGWQGRYCDECIRYPGCLHGTCQQPWQCNCQE

                       290       300       310       320       330       340       350
                ....|....|....|....|....|....|....|....|....|....|....|....|....|....|
NOV8            ----------------------------------------------------------------------
gi|13027596|    ----------------------------------------------------------------------
gi|6682739|     ----------------------------------------------------------------------
gi|6681197|     GWGGLFCNQDLNYCTHHKPCRNGATCTNTGQGSYTCSCRPGYTGANCELEVDECAPSPCKNGASCTDLED
gi|14091746|    GWGGLFCNQDLNYCTHHKPCRNGATCTNTGQGSYTCSCRPGYTGANCELEVDECAPSPCRNGGSCTDLED
gi|807696|      GWGGLFCNQDLNYCTHHKPCENGATCTNTGQGSYTCSCRPGYTGSNCEIEVNECDANPCKNGGSCSDLEN

                       360       370       380       390       400       410       420
                ....|....|....|....|....|....|....|....|....|....|....|....|....|....|
NOV8            --------------------------------------------------------------MRPCSNGA
gi|13027596|    --------------------------------------------------------------MRPCSNGA
gi|6682739|     ----------------------------------------------------------------------
gi|6681197|     SFSCTCPPGFYGKVCELSAMTCADGPCFNGGRCSDNPDGGYTCHCPLGFSGFNCEKKMDLCGSSPCSNGA
gi|14091746|    SYSCTCPPGFYGKVCELSAMTCADGPCFNGGRCSDNPDGGYTCHCPAGFSGFNCEKKIDLCSSSPCSNGA
gi|807696|      SYTCSCPPGFYGKNCELSAMTCADGPCFNGGRCADNPDGGYICFCPVGYSGFNCEKKIDYCSSNPCSNGA

                       430       440       450       460       470       480       490
                ....|....|....|....|....|....|....|....|....|....|....|....|....|....|
NOV8            TCWDGINRCSCLCPEGFCCRCCTINCDDCASRFCQRCARCRIRVHDFDCLCFSGYGGKTCELVCP-VPDP
gi|13027596|    TCWDGINRCSCLCPEGFCCRCCTINCDDCASRFCQRCARCRIRVHDFDCLCFSGYGGKTCELVCP-VPDP
gi|6682739|     ----------------------------------------------------------------------
gi|6681197|     KCSDLGNSCLCRCQADFSCRCCEDNCDLCNCSLCANCGTCRCSVCDFSCTCHPSYTCHNCSAPCSRCEHA
gi|14091746|    KCWDLGNSCLCRCQTCFSGRCCEDNCDDCACSPCANCGTCRCSVCDFSCTCHPSYTCHNCSAPCSRCEHA
gi|807696|      RCEDLGNSCICQCQECDCRCNCDDNCDLCTCFCCQNCGTCRCGCRCCSCTCCPSCICHNCSMPCTKCEHN

                       500       510       520       530       540       550       560
                ....|....|....|....|....|....|....|....|....|....|....|....|....|....|
NOV8            CTTVDTPLGPTSAVVCPATGPAPHSCCAGLCR---------CSCKECCRRQCAC----CGEPSLCALVCF
gi|13027596|    CTTVDTPLGPTSAVVCPATGPAPHSCCAGLCR---------CSCKECCRRQCAC----CGEPSLCALVCF
gi|6682739|     --------MPTCAVVCPATGPAPHSCCAGLCR---------CSCKECC---------------------F
gi|6681197|     FCHNGATCHQRGQRYCCECAQGYGGPNCQFCLPEPPPGPMVCDCSCRHMESCGCPFPWCAVCCGCVCVCL
gi|14091746|    FCHNGATCHQRGQRYCCECAQGYGGCNCQFCLPEPPP--------CCCVAACGCSFPWCAVCCGCVCVCL
gi|807696|      FCHNGATCHERCNRYCCQCARGYGGNNCQFCLPEEKP--VVCDCTCKYTEGCSCQFPWCAVCCGCVCCEM

                       570       580       590       600       610       620       630
                ....|....|....|....|....|....|....|....|....|....|....|....|....|....|
NOV8            GAPTAPLVGATCLCTLCAWCRGVCCPCPCCYPACCYAHACCCCECQVSCG--------------------
gi|13027596|    GAPTAALVGATCLCTCCAWCRGVCCPCPCCYPACCYALACCCCECQVSML--------------------
```

```
gi|6682739|   GSLTAALLMATLLMTLRAWMRGICHTLPCCYPAEHYALAS   CQVS-------------------
gi|6681197|   LLLGCAAMLVCYRLKLSKHLPPPEHCSGETETMNLLANC    VSVS  GATQIKNTNKKADFHGDHGA
gi|14091746|  LLLGCAAMLVCYRLKLSKHLPPPDICSGETETMNLLANC    VSVS  GATQIKNTNKKADFHGDHGA
gi|807696|    LLLGCAAMLVCYRSRS KRFHQPEACRGESKTMNLLANC    ISVSF GTTQIKNTNKKIDFLSESNN

                    640       650       660       670       680       690       700
              ....|....|....|....|....|....|....|....|....|....|....|....|....|....|
NOV8          ----------PAGLPLPRDLP------------------------------------------PEPGK
gi|13027596|  ----------PAGLPLPRDLP------------------------------------------PEPGK
gi|6682739|   ----------PAGSPLSPDLP------------------------------------------PEPGK
gi|6681197|   KKSSFKVRYPTVDSNLVRDLKGDEATVRDTHSKRDTKCQSQSSAGEEKIAPTLRGGEIPDRKRPESVY
gi|14091746|  DKSSFKARYPTVDSNLIRDLKGDEATVRDAHSKRDTKCQSQGSVGEEKSTSTLRGGEVPDRKRPESVY
gi|807696|    EKNGYKPRYPSVDSNLVHKLK-NEDSPKEERSKCEAKCSSNDSDSED-VNSVHSKRDSSERRRPESAY

                    710       720
              ....|....|....|....|....|
NOV8          LLSCL--------------------
gi|13027596|  L-----------------------
gi|6682739|   L-----------------------
gi|6681197|   KKSTKYQSVYVLSAEKDECVIATEV
gi|14091746|  KKSTKYQSVYVLSAEKDECVIATEV
gi|807696|    KKSTKYQSVYVISDEKDECIIATEV
```

Table 8F lists the domain description from DOMAIN analysis results against NOV8. This indicates that the NOV8 sequence has properties similar to those of other proteins known to contain these domains.

TABLE 8F

| Domain Analysis of NOV8 |
|---|
| gnl Pfam pfam00008, EGF, EGF-like domain. There is no clear separation between noise and signal. pfam00053 is very similar, but has 8 instead of 6 conserved cysteines. Includes some cytokine receptors. The EGF domain misses the N-terminus regions of the Ca2+ binding EGF domains (this is the main reason of discrepancy between swiss-prot domain start/end and Pfam). The family is hard to model due to many similar but different sub-types of EGF domains. Pfam certainly misses a number of EGF domains. (SEQ ID NO:110) |
| Length = 33 residues, 84.8% aligned<br>Score = 35.0 bits (79), Expect = 0.004 |

```
NOV8:    3  PCANGATCLDGINRFSCLCPEGFAGRFC    30
            ||+|| ||++    ++|+|| |+ |+ |
00008:   6  PCSNGGTCVNTPGGYTCICPPGYTGKRC    33
```

The above defined information for NOV8 suggests that NOV8 may function as a member of a S-1 protein family. Therefore, the NOV8 nucleic acids and proteins of the invention are useful in potential therapeutic applications implicated in various diseases and disorders described below and/or other pathologies. For example, the NOV8 compositions of the present invention will have efficacy for treatment of patients suffering from: adrenoleukodystrophy, congenital adrenal hyperplasia, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, renal artery stenosis, interstitial nephritis, glomerulonephritis, polycystic kidney disease, systemic lupus erythematosus, renal tubular acidosis, IgA nephropathy, cirrhosis, transplantation, systemic lupus erythematosus, autoimmune disease, asthma, emphysema, scleroderma, allergy, ARDS, fertility, diabetes, pancreatitis, obesity, endocrine dysfunctions, growth and reproductive disorders and/or endometriosis. The NOV8 nucleic acid encoding S-1-like protein, and the S-1-like protein of the invention, or fragments thereof, may further be useful in diagnostic applications, wherein the presence or amount of the nucleic acid or the protein are to be assessed.

NOV9

A disclosed NOV9 nucleic acid of 3981 nucleotides (also referred to CG55997-02) encoding a novel Guanine Nucleotide Releasing Protein-like protein is shown in Table 9A. An open reading frame was identified beginning with an ATG initiation codon at nucleotides 1–3 and ending with a TGA codon at nucleotides 3772–3774. A putative untranslated region downstream from the termination codon is underlined in Table 9A, and the start and stop codons are in bold letters.

TABLE 9A

| NOV9 Nucleotide Sequence |
|---|
| (SEQ ID NO:19) |
| **ATG**CAGAAAGCCATCCGACTTAATGATGGCCACGTCGCGCCCCTGGGACTGCTGGCGCGCAAGGACGGCACGCGCAAAGG |
| CTACCTGAGCAAGCGGAGTTCGGACAACACAAAATGGCAAACCAAGTGGTTCGCGCTGCTGCAGAACCTGCTCTTCTACT |
| TCGAGAGCGACTCGAGCTCGCGGCCCTCGGGGCTTTACCTGCTGGAGGGCTGCGTCTGCGACCGCGCGCCCTCCCCCAAG |
| CCGGCGCTGTCGGCCAAGGAGCCGCTGGAGAAACAGCATTACTTCACGGTGAACTTCAGCCATGAGAACCAGAAAGCCTT |
| GGAGCTGAGGACAGAGGACGCAAAAGATTGTGACGAATGGGTGGCAGCCATTGCACATGCCAGCTACAGGACCCTCGCCA |
| CAGAGCATGAGGCATTAATGCAGAAATACCTGCACCTGCTGCAGATCGTGGAGACAGAGAAGACCGTGGCCAAGCAGCTT |
| CGGCAGCAGATCGAGGATGGGGAGATCGAGATCGAGCGGCTGAAGGCAGAGATCACATCCCTGCTCAAGGACAATGAGCG |
| CATCCAGTCCACCCAGACTGTCGCCCCCAACGATGAAGACAGCGACATCAAGAAAATTAAGAAGGTGCAGAGCTTCCTGC |
| GGGGCTGGCTGTGCCGGCGGAAGTGGAAGACCATCATCCAGGACTACATCCGGTCACCCCATGCTGACAGCATGCGCAAG |
| AGGAACCAGGTGGTGTTCAGCATGCTGGAGGCTGAGGCTGAGTACGTGCAGCAGCTGCACATCCTTGTCAACAATTTCCT |
| GCGCCCGCTGCGGATGGCCGCCAGCTCCAAGAAGCCTCCCATCACACACGACGACGTCAGCAGCATCTTCCTGAACAGCG |
| AAACCATCATGTTTTTACATCAGATCTTTTACCAAGGCCTGAAGGCCCGCATCTCCAGCTGGCCCACGCTGGTCCTGGCT |
| GACCTATTTGACATCCTGCTGCCCATGCTCAACATCTACCAAGAGTTCGTCCGCAACCACCAGTACAGCCTGCAGATCCT |
| GGCCCACTGCAAGCAGAACCGTGACTTCGACAAGCTGCTGAAGCACTACGAGGCCAAGCCTGACTGCGAGGAGAGGACGC |
| TGGAGACCTTCCTCACCTACCCCATGTTCCAGATCCCCAGGTACATCCTGACCCTCCATGAGCTCCTGGCCCACACGCCT |
| CATGAGCACGTTGAGCGCAACAGCCTGGACTACGCCAAGTCCAAACTGGAGGAGCTGTCCAGAATAATGCACGATGAAGT |
| AAGTGAGACGGAGAACATCCGGAAAAACCTGGCCATCGAGCGCATGATCATCGAAGGCTGTGAGATCCTCCTGGACACCA |
| GCCAGACCTTTGTGAGACAAGGTTCCCTCATTCAGGTGCCCATGTCTGAAAAGGGCAAGATCACCAGGGGGCGCCTGGGG |
| TCTCTCTCCCTAAAGAAAGAGGGCGAGCGACAGTGCTTCCTGTTTTCTAAGCATCTGATTATCTGTACCAGAGGCTCTGG |

TABLE 9A-continued

| NOV9 Nucleotide Sequence |
| --- |
| AGGGAAGCTTCACTTGACCAAGAATGGAGTCATATCCCTCATTGACTGCACTTTATTGGAGGAGCCAGAAAGCACGGAGG |
| AGGAAGCCAAAGGATCCGGCCAAGACATAGATCACTTGGATTTTAAAATCGGGGTGGAGCCAAAGGATTCCCCGCCCTTT |
| ACAGTCATCCTAGTGGCCTCGTCCAGACAGGAGAAGGCAGCGTGGACCAGTGACATCAGCCAGTGTGTGGATAACATCCG |
| ATGCAATGGGCTCATGATGAACGCATTTGAAGAAAATTCCAAGGTCACTGTGCCGCAGATGATCAAGTCCGACGCCTCCT |
| TATATTGTGATGATGTTGACATTCGCTTCAGCAAAACCATGAACTCCTGCAAAGTGCTGCAGATCCGCTACGCCAGTGTG |
| GAGCGGCTGCTGGAGAGGCTGACGGACCTGCGCTTCCTGAGCATCGACTTCCTCAACACCTTCCTGCACTCCTACCGCGT |
| CTTCACCACCGCCATCGTGGTCCTGGACAAGCTCATTACCATCTACAAGAAGCCTATCAGTGCCATTCCTGCCAGGTCGC |
| TGGAGCTCCTGTTTGCCAGTGGCCAGAACAATAAGCTCCTGTACGGTGAACCCCCCAAGTCCCCGCGCGCCACCCGCAAG |
| TTCTCCTCGCCGCCACCTCTGTCCATCACCAAGACATCGTCACCGAGCCGCCGGCGGAAGCTCTCCCTGAACATCCCCAT |
| CATCACTGGCGGCAAGGCCCTGGACCTGGCCGCCCTCAGCTGCAACTCCAATGGCTACACCAGCATGTACTCGGCCATGT |
| CACCCTTCAGCAAGGCCACGCTGGACACCAGCAAGCTCTATGTGTCCAGCAGCTTCACCAACAAGATTCCAGATGAGGGC |
| GATACGACCCCTGAGAAGCCCGAAGACCCTTCAGCGCTCAGCAAGCAGAGCTCAGAAGTCTCCATGAGAGAGGAGTCAGA |
| TATTGATCAAAACCAGAGTGATGATGGTGATACTGAAACATCACCAACTAAATCTCCAACAACACCCAAATCAGTCAAAA |
| ACAAAAATTCTTCAGAGTTCCCACTCTTTTCCTATAACAATGGAGTCGTCATGACCTCCTGTCGTGAACTGGACAATAAC |
| CGCAGTGCCTTGTCGGCCGCCTCTGCCTTTGCCATAGCAACCGCCGGGGCCAACGAGGGCACCCCAAACAAGGAGAAGTA |
| CCGGAGGATGTCCTTAGCCAGTGCAGGGTTTCCCCCAGACCAGAGGAATGGAGACAAGGAGTTTGTGATCCGCAGAGCAG |
| CCACCAATCGTGTCTTGAACGTGCTCCGCCACTGGGTGTCCAAGCACTCTCAGGACTTTGAGACCAACGATGAGCTCAAA |
| TGCAAGGTGATCGGCTTCCTGGAAGAAGTCATGCACGACCCGGAGCTCCTGACCCAGGAGCGGAAGGCTGCAGCCAACAT |
| CATCAGGACTCTGACCCAGGAGGACCCAGGTGACAACCAGATCACGCTGGAGGAGATCACGCAGATGGCTGAAGGCGTGA |
| AGGCTGAGCCCTTTCAAAACCACTCAGCCCTGGAGATCGCGGAGCAGCTGACCCTGCTAGATCACCTCGTCTTCAAGAAG |
| ATTCCTTATGAGGAGTTCTTCGGACAAGGATGGATGAAACTGGAAAAGAATGAAAGGACCCCTTATATCATGAAAACCAC |
| TAAGCACTTCAATQACATCAGTAACTTGATTGCTTCAGAAATCATCCGCAATGAGGACATCAACGCCAGGGTGAGCGCCA |
| TCGAGAAGTGGGTGGCCGTAGCTGACATATGCCGCTGCCTCCACAACTACAATGCCGTACTGGAGATCACCTCGTCCATG |
| AACCGCAGTGCAATCTTCCGGCTCAAAAAGACGTGGCTCAAAGTCTCTAAGCAGACTAAAGCTTTGATTGATAAGCTCCA |
| AAAGCTTGTGTCATCTGAGGGCAGATTTAAGAATCTCAGAGAAGCTTTGAAAAATTGTGACCCACCCTGTGTCCCTTACC |
| TGGGGATGTACCTCACCGACCTGGCCTTCATCGAGGAGGGGACGCCCAATTACACGGAAGACGGCCTGGTCAACTTCTCC |
| AAGATGAGGATGATATCCCATATTATCCGAGAGATTCGCCAGTTTCAACAAACTGCCTACAAAATAGAGCACCAAGCAAA |
| GGTAACGCAATATTTACTGGACCAATCTTTTGTAATGGATGAAGAAAGCCTCTACGAGTCTTCTCTCCGAATAGAACCAA |
| AACTCCCCACC**TGA**AGCTGTGCCCAGCCCAGACCCAGCTGCTCCCGGGGACATGTGCTAGATGATACTGTACATATTCGT |
| TTGGTTTCACTGGATTTTCTTCTTCAGTATGTGCTTCTCCAAGAATACAAATCGTCCTTGTTCTTAGATTCCTGTAGAAC |
| CGGAATATGAATTTCTGCACCGTTTCAGACTTCGCCCACCCATCCCTCCCCTCGCCCGAAT |

The disclosed NOV9 nucleic acid sequence, maps to chromosome 15q24, has 2642 of 2650 bases (99%) identical to the unidentified mRNA of Sequence 1 from Patent WO9321314 (gb:GENBANK-ID:A75965|acc:A75965.1) (E=0.0).

A disclosed NOV9 polypeptide (SEQ ID NO:20) encoded by SEQ ID NO:19 is 1257 amino acid residues and is presented using the one-letter amino acid code in Table 9B. Signal P, Psort and/or Hydropathy results predict that NOV9 does not contain a signal peptide and is likely to be localized to the plasma membrane with a certainty of 0.5500 and in the endoplasmic reticulum (membrane) with a certainty of 0.5000.

TABLE 9B

| Encoded NOV9 protein sequence. |
|---|
| (SEQ ID NO:20)<br>MQKAIRLNDGHVAPLGLLARKDGTRKGYLSKRSSDNTKWQTKWFALLQNLLFYFESDSSSRPSGLYLLEGCVCDRAPSPK<br>PALSAKEPLEKQHYFTVNFSHENQKALELRTEDAKDCDEWVAAIAHASYRTLATEHEALMQKYLHLLQIVETEKTVAKQL<br>RQQIEDGEIEIERLKAEITSLLKDNERIQSTQTVAPNDEDSDIKKIKKVQSFLRGWLCRRKWKTIIQDYIRSPHADSMRK<br>RNQVVFSMLEAEAEYVQQLHILVNNFLRPLRMAASSKKPPITHDDVSSIFLNSETIMFLHQIFYQGLKARISSWPTLVLA<br>DLFDILLPMLNIYQEFVRNHQYSLQILAHCKQNRDFDKLLKHYEAKPDCEERTLETFLTYPMFQIPRYILTLHELLAHTP<br>HEHVERNSLDYAKSKLEELSRIMHDEVSETENIRKNLAIERMIIEGCEILLDTSQTFVRQGSLIQVPMSEKGKITRGRLG<br>SLSLKKEGERQCFLFSKHLIICTRGSGGKLHLTKNGVISLIDCTLLEEPESTEEEAKGSGQDIDHLDFKIGVEPKDSPPF<br>TVILVASSRQEKAAWTSDISQCVDNIRCNGLMMNAFEENSKVTVPQMIKSDASLYCDDVDIRFSKTMNSCKVLQIRYASV<br>ERLLERLTDLRFLSIDFLNTFLHSYRVFTTAIVVLDKLITIYKKPISAIPARSLELLFASGQNNKLLYGEPPKSPRATRK<br>FSSPPPLSITKTSSPSRRRKLSLNIPIITGGKALDLAALSCNSNGYTSMYSAMSPFSKATLDTSKLYVSSSFTNKIPDEG<br>DTTPEKPEDPSALSKQSSEVSMREESDIDQNQSDDGDTETSPTKSPTTPKSVKNKNSSEFPLFSYNNGVVMTSCRELDNN<br>RSALSAASAFAIATAGANEGTPNKEKYRRMSLASAGFPPDQRNGDKEFVIRRAATNRVLNVLRHWVSKHSQDFETNDELK<br>CKVIGFLEEVMHDPELLTQERKAAANIIRTLTQEDPGDNQITLEEITQMAEGVKAEPFENHSALEIAEQLTLLDHLVFKK<br>IPYEEFFGQGWMKLEKNERTPYIMKTTKHFNDISNLIASEIIRNEDINARVSAIEKWVAVADICRCLHNYNAVLEITSSM<br>NRSAIFRLKKTWLKVSKQTKALIDKLQKLVSSEGRFKNLREALKNCDPPCVPYLGMYLTDLAFIEEGTPNYTEDGLVNFS<br>KMRMISHIIREIRQFQQTAYKIEHQAKVTQYLLDQSFVMDEESYLESSLRIEPKLPT |

The NOV9 amino acid sequence has 807 of 813 amino acid residues (99%) identical to, and 809 of 813 amino acid residues (99%) similar to, the 814 amino acid residue unidentified protein of Sequence 1 from Patent WO9321314 (ptnr:REMTREMBL-ACC:CAB58578) (E=0.0).

NOV9 is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, and uterus. This information was derived by determining the tissue sources of the sequences that were included in the invention including but not limited to SeqCalling sources, Public EST sources, Literature sources, and/or RACE sources.

NOV9 also has homology to the amino acid sequences shown in the BLASTP data listed in Table 9C.

TABLE 9C

BLAST results for NOV9

| Gene Index/ Identifier | Protein/Organism | Length (aa) | Identity (%) | Positives (%) | Expect |
|---|---|---|---|---|---|
| gi\|13124259\|sp\|Q13972\|GNRP_HUMAN | guanine nucleotide releasing protein (GNRP) (RAS-specific nucleotide exchange factor CDC25) [*Homo sapiens*] | 1275 | 1208/1275 (94%) | 1212/1275 (94%) | 0.0 |
| gi\|228955\|prf\|\|1814463A | guanine nucleotide-releasing factor [*Rattus norvegicus*] | 1244 | 1032/1258 (82%) | 1118/1258 (88%) | 0.0 |

TABLE 9C-continued

BLAST results for NOV9

| Gene Index/ Identifier | Protein/Organism | Length (aa) | Identity (%) | Positives (%) | Expect |
|---|---|---|---|---|---|
| gi\|2522208\|gb\| AAB80953.1\| (AF023130) | Ras-GRF2 [*Homo sapiens*] | 1237 | 816/1266 (64%) | 974/1266 (76%) | 0.0 |
| gi\|6755288\|ref\|NP_ 035375.1\| (NM_011245) | RAS protein-specific guanine nucleotide-releasing factor 1; RAS guanyl releasing protein 3; GRF beta; Ras guanine release factor beta [*Mus musculus*] | 1262 | 1035/1265 (81%) | 1116/1265 (87%) | 0.0 |
| gi\|11360360\|pir\|\| T42726 | guanine nucleotide release/exchange factor Ras-GRF2 - mouse [*Mus musculus*] | 1189 | 554/834 (66%) | 654/834 (77%) | 0.0 |

The homology of these sequences is shown graphically in the ClustalW analysis shown in Table 9D.

Table 9D Information for the ClustalW proteins

1) NOV9 (SEQ ID NO:20)

2) gi 13124259|sp Q13972 GNRP_HUMAN guanine nucleotide releasing protein (GNRP) (RAS-specific nucleotide exchange factor CDC25) [Homo sapiens] (SEQ ID NO:111)

3) gi 228955|prf||1814463A guanine nucleotide-releasing factor [Rattus norvegicus] (SEQ ID NO:112)

4) gi 2522208|gb AAB80953.1 (AF023130) Ras-GRF2 [Homo sapiens] (SEQ ID NO:113)

5) gi 6755288 ref|NP_035375.1| (NM_011245) RAS protein-specific guanine nucleotide-releasing factor 1; RAS guanyl releasing protein 3; GRF beta; Ras guanine release factor beta [Mus musculus] (SEQ ID NO:114)

6) gi 11360360|pir T42726 guanine nucleotide release/exchange factor Ras-GRF2 – mouse [Mus musculus] (SEQ ID NO:115)

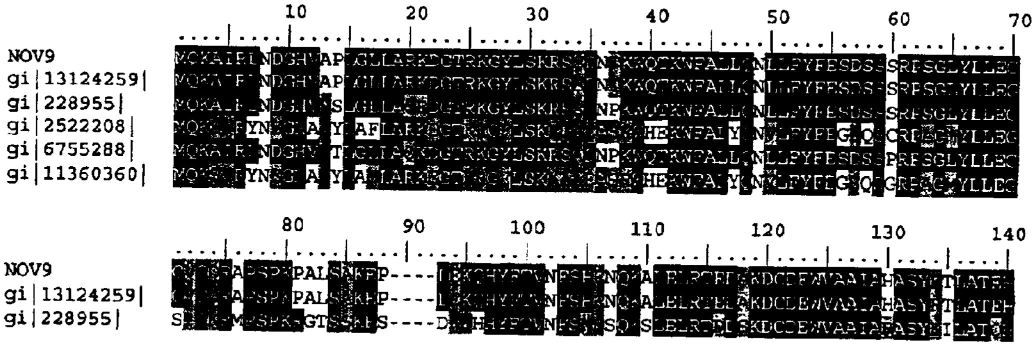

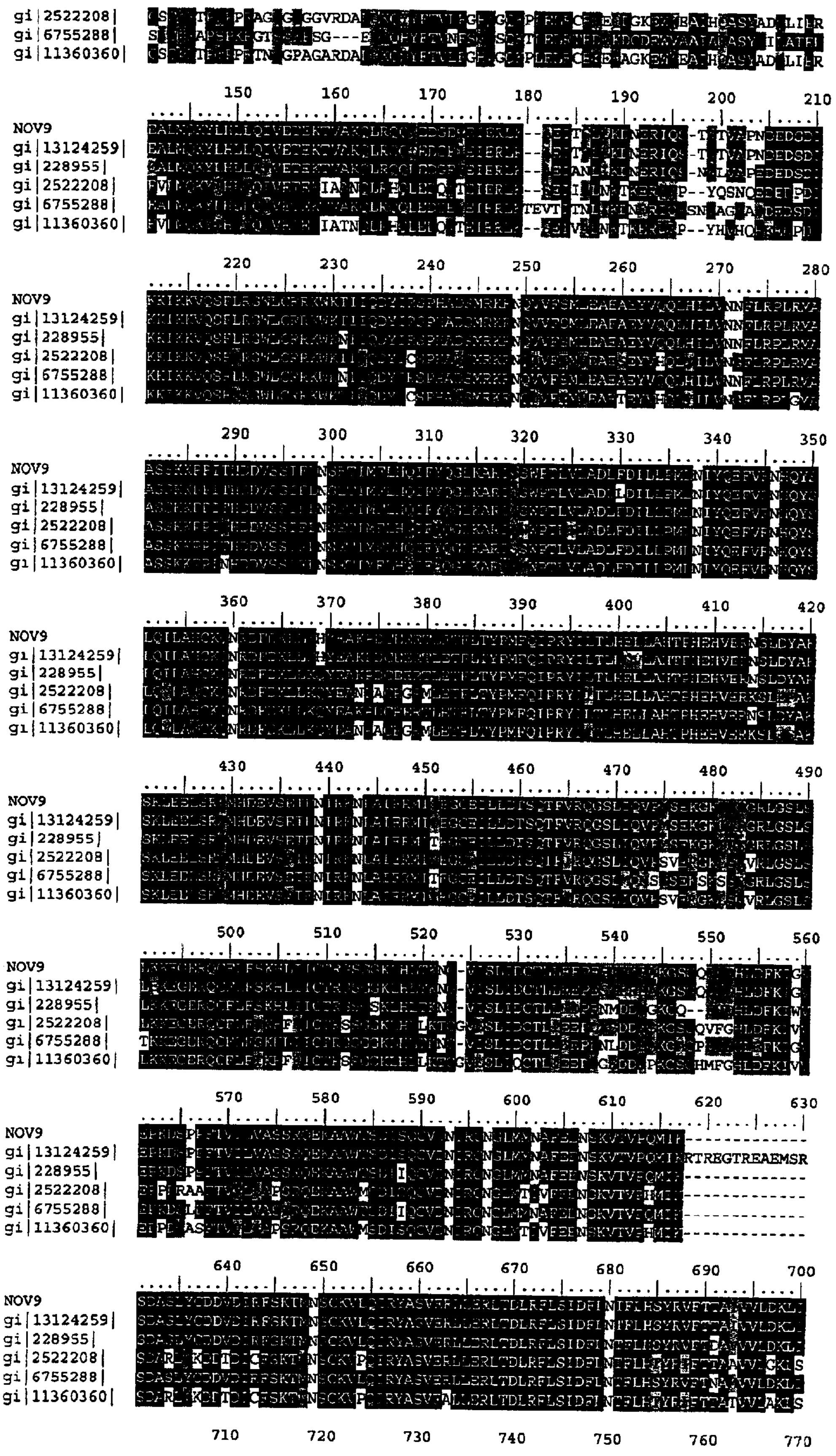

```
gi|2522208|     .S..T..P.AG.G.GGVRDA.......VIAG.G..P..C...GK....A.HCA..AD.LI.R
gi|6755288|     S....APS...GI..SG---E..HYFT.N.S...C.T..T.D..DC.E.AA.A.SY..ATF.
gi|11360360|    .S..T..P.TN.GPAGARDA.......ETVG.G..PLE.C..AGKE..EA.HCA.AD.LI.R

                             150       160       170       180       190       200       210
                          ....|....|....|....|....|....|....|....|....|....|....|....|....|
NOV9            EAL..YLH.LQIVETE.KTVAK..LR.Q..EDD......IERL....FT..KI.NERIQ--T.TV.PNDEDSD.
gi|13124259|    EAL..YLH.LQIVETE.KTVAK..LR.W..ED.C....SIERL....FT..KI.NERIQ--T.TV.PNDEDSD.
gi|228955|      .AL..YLH.L....E.....AK..LR.Q..RD.P....SIERL....FT.AN..KI.NERIQ--N.LV.PEDEDSD.
gi|2522208|     .V...Y..MF.TT..IA.N.L..LE..L.Q...IER........LN..T.KE...P--YQSNQ.P.T.D.
gi|6755288|     .A..RAY.H.LL...V..AKT..LR.Q.LE.D....SIHER.....TEVT.TN....S....SN..AG..DEDSD.
gi|11360360|    .V.....Q.M..E..IATN...L..LE..Q.T.IERL......VR...N..T.KR..P--YH.H.....P.

                             220       230       240       250       260       270       280
                          ....|....|....|....|....|....|....|....|....|....|....|....|....|
NOV9            KI.RKV.SFLR..LC..R.KNKTI..QDY..R.PHAD.MR.E..QV.FSK.EAEA.Y.QQLHIL.NN.LRP.RVA
gi|13124259|    KI.RKV.QFLR.VLC..R.KNKTI..QDY..R.PHAD.DMR.E..QV.FSM.EAEA.Y.VQQLHIL.VNN.LRP.LRVA
gi|228955|      KI.RKV..FLR..LC..R.KQ.N...IQDY..R.PHAD.MR.KN..QV.FSM.EAEA.Y.VQQLHIL.VNN.LRP.LRVA
gi|2522208|     KHIRKV.NE..L.DLC.R.KAI.NI..DY..S.PH.A..K.RK..QP.TI.ADL.FDILI.PM.NI.YQ.BFV.ENS.QY.
gi|6755288|     KHIRKV.QS-LR..DLC.R.KA.IN...DY..S.PHA.SMR.RK..QV.FSM.EAEA.BY.VQQLHIL.VNN.F.RPLR.VA
gi|11360360|    KI.IRK.VQS.HO.SW.LC.K...KWT.I...QDY..C.SPHAA.S.R.KN..V.F.NFEA.TVA..E..IL..ABP.G.V.

                             290       300       310       320       330       340       350
                          ....|....|....|....|....|....|....|....|....|....|....|....|....|
NOV9            AS..KKFP.IT.HED.A.SS.IF...N.SF.T.IMPL.RIQ.F.YQ.BLKAR..SR.FT.LV..LADLFDILLSK.NIYQSBFV.EN.QY.
gi|13124259|    AS.PKFFI.IT.H.DV.G.S.IF...L.U.KIKAL.IQI.F.YQD.BLKAR..SW.FT.LV.LAD..LEDIL.L.R.K.NIYQ.BFV.IN.NQY.
gi|228955|      AS..KKFF.I.N.D.V.SS.IE...IN.PLH.DC.F.YD.QI.T.R...SPTI.FT..LADLFDILI.PM.NI.YQ.FV.E.SQYE
gi|2522208|     AS.SKFFI.I.E.DVSS....N...PL.H.DQ.F.YO.H.F.A.R...SNP.TL.VL.ADLFD.LL.PM.NI.YQ.BFV.N.EQY.
gi|6755288|     AS.SKFFE.P.I.NE.DVSS....N.L.C.TIYE.FS.E.Q.F.HQ.T.FAR...NC.TL.VL.ADL.FD.TI.I.PM.NI.YQ.BFV.EN.QY.

                             360       370       380       390       400       410       420
                          ....|....|....|....|....|....|....|....|....|....|....|....|....|
NOV9            LQIIAHCK..N.....PL.R.T.T.H..BAR-D.T.....TETLTYPMFQ.I.PRY..IT.TH.EL.LA.HTPHEB.VE..N.SLDYA.
gi|13124259|    LQILAICH..NR.DT.CR.LL...H..AAR.DD.E....SPEETFLI.TYPFVFQI.PRY..IT.LN..LA.HTPHES.IV.E..NSL.DYA.
gi|228955|      LQ.TIA..CK...N.E..PC.VL.LN.YE.AN..A.FT.G.M.BEPL.TY.PMFQI.PRY.. I.T.T.HELI.LAH.T.PHER.VE.RKS.L..
gi|2522208|     IQT.LA..CK..NE.PC.V.L.LKNYE..L..CR.FT.TE.P.L.TY.PMFQI.PRY.I.T.T.HELI.A.FT.PHER.VR.PN..SL.DYA.
gi|6755288|     LQ.LAV..CK..NN.IF.E.V.LK.UV.ISN.N.A.GI...TG.MS.EPD.LTY.PMPQI.PRY.IT.T.U.SELLAH.TPHERV..ERKSL..F..

                             430       440       450       460       470       480       490
                          ....|....|....|....|....|....|....|....|....|....|....|....|....|
NOV9            SK.LEE.L.EK...MH.DEVS.R.I.H..NT.IR.NM..AI.ER.M.I.E.SL.BELL.LDTS.TF.VRQ.GSL.IQV.F...S.KGF...GKLGSL.
gi|13124259|    SK.LE.EL.S.R.MHDEVS.R.II.RKM...AI..R.HI...G.CE.ILL.DTSQT.FVRQGSLI.QV.F..S.EKGF..GRLGSL.
gi|228955|      SK.FF.E.SP..M.IL.EV..S..NI..N.LA.I.F.K.H...T...L.LLD.TS.T.F.V.RQ.SL.I.QV.F.SV..R.SK...V.L.GSL.
gi|2522208|     SAL.AEE.L.S..NI.LEV..S..NI.KN.LAI.S.R.N.FT..L.LL.DTS.T.F.V.RQ.SL.IQ.V.F.SV..R.GK..V.R.LGSL.
gi|6755288|     SKLED.E.SR..MH.EVS.R.ETNIR.R.N.LAT.SR.N.TR.U.C.E.ILL.DTS.V.T.F.VR.Q.SL.TO.S..SESR..S.R.LGSLL
gi|11360360|    SKLED.E.S..MH.DEVS.T.TNIR.HN..AIS.R.N.I.R.UCE.ILL.DTS.QF..RQ.CSL.I.QV.F.SV..R.GK..V.R.LGSLE

                             500       510       520       530       540       550       560
                          ....|....|....|....|....|....|....|....|....|....|....|....|....|
NOV9            L.N..Q..R.Q..F..SK..L.ICT.S.S.RK..HI..N---VISL.ICT.L.R..P.N..D.GKS.Q....HLDFK.G
gi|13124259|    LK.QCERQCF.F.SKH.L.TCTR.N.S.EKLI.H.M..I.-VISL.DCT.L.B..P.N.MDL.GKS.Q.....HLDFK..G
gi|228955|      LK.QCERQCF.F.FN.CT.SE.RK.N..H..LATE.G-V.SL.ID.CTL.L..P.M.DL.GK.Q--..I..V.FG.HLDFK..IW
gi|2522208|     TK.NE..Q.RO..CF..I.F.GK.IT..P.L.SOOD.KH..IA.TG-V.SL.IDCTL...R.P..NLD.KS.GC.LQV.F.G.HLD.FK..V
gi|6755288|     LK.RC.ERQCF.L.FS.K.H.L.ICP.L.TS..RO.DKI.HI.L.GE.G.V.SL.IQC.TL.SSDEI.GE.D.P.K.CS..HMFG.HLDFKLV

                             570       580       590       600       610       620       630
                          ....|....|....|....|....|....|....|....|....|....|....|....|....|
NOV9            SR.F.DSP.F.TV.T..KVASS.KOEA.AAW.S...SG.CKV.M..KING.L.KAV.NA.FE..N.S.KVTVP.QMTH------------
gi|13124259|    ER.IT.P.FTV.T.LVASS.ADFA.AWT.SO.L.ECOVTB.NK..BIGN.GLIM.M.NA.FE..NS.KVTVP.QM.I.ERTREGTREAEMSR
gi|228955|      .F.F.RAA..TV.I..N..QPDQ..A.ANT.MS.T.I.QV.M.N.B.RQN.GL.HT.V.FE..NQKVTVB.QMI.-------------
gi|2522208|     .E.IR.KL.I.TV.L.VAC..AQ.DB.AA..WT.S.I.T.DQVN.NB.EQNG.L.A.P.NA.FE..LN.KVTV.FE.QMI.-------------
gi|6755288|     BR.PEP..ASC.TV.T.L..DK.AAMBSD.IS.QGV.M.N.BB.RQNGL.KT.TV.FE.EN.KVTB.V.HM.I--------------

                             640       650       660       670       680       690       700
                          ....|....|....|....|....|....|....|....|....|....|....|....|....|
NOV9            SD.ASLYCDDVD.IR.FSK.IT.N.S.C.KVL.Q..R.YAS.V..ER..LL.ERL.TDLR.FL.SID.FI.N.F.LHSYR.VFTA..VVLDKL.
gi|13124259|    SDAS.LYCDDVD.IR.FSSK.IT.N.SCK.VL.Q.R.YA.SG.VE.RL.ERL.T.DLR.FLS.IDFI.N.FLH.SYR.VFTA..VVLDKL.
gi|228955|      SD.PAS.LYCDDVD.IR.FSKT.N.CK..VL.F.RYA.SVER..LL.ERL.TDLR.FLS.IDFI.N.F.LHS.YR.VFTA.AVV.LDKL.
gi|2522208|     SD.AE.K.DTC.R.PFS.SK.LT.N.NCKVL..P.I.RYA.SV.ER..LL.ERL.TDLR.FLS.ID.FI.N.F.L.HSY.R.VFT.AAV.VC.K.S
gi|6755288|     SD.ASL.Y.CDDVD.IR.FSK.T.N.NSCK.V.P.RYA.SV.A.LL.ERL.TDLR.FLS.ID.FI.N.F.LHS.YR.VFT.AT.VV.A.K.S

                             710       720       730       740       750       760       770
```

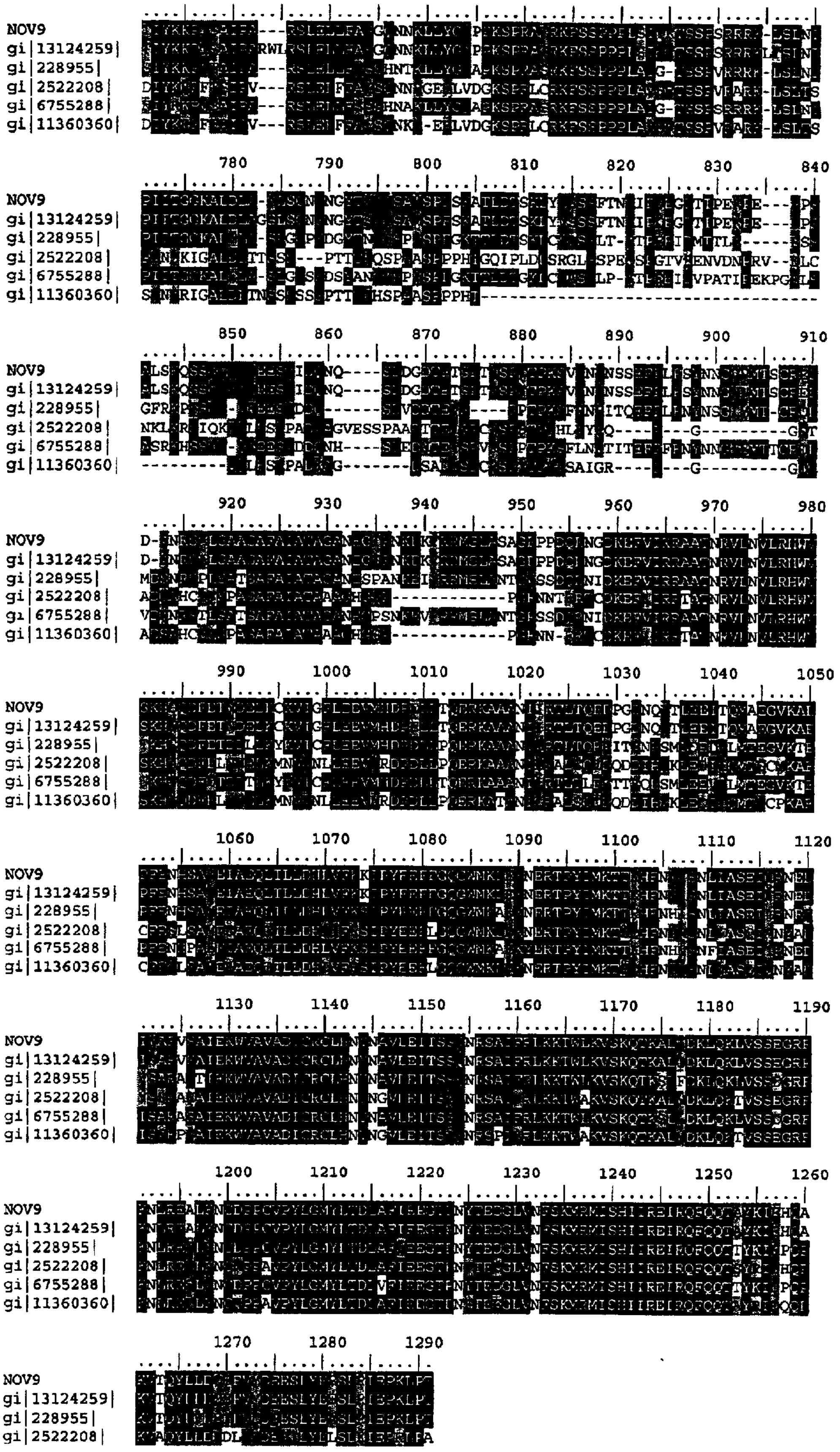
NOV9
gi|13124259|
gi|228955|
gi|2522208|
gi|6755288|
gi|11360360|
780 790 800 810 820 830 840
850 860 870 880 890 900 910
920 930 940 950 960 970 980
990 1000 1010 1020 1030 1040 1050
1060 1070 1080 1090 1100 1110 1120
1130 1140 1150 1160 1170 1180 1190
1200 1210 1220 1230 1240 1250 1260
1270 1280 1290

| | |
|---|---|
| gi\|6755288\| | K I QYLLDF SF DEESLYE SILLIEPKLPT |
| gi\|11360360\| | K I QYLLD LV DE SLYTLSL IEP LPA |

Tables 9E–9J list the domain description from DOMAIN analysis results against NOV9. This indicates that the NOV9 sequence has properties similar to those of other proteins known to contain these domains.

TABLE 9E

Domain Analysis of NOV9 gnl|Smart smart00147, RasGEF, Guanine nucleotide exchange factor for Ras-like small GTPases (SEQ ID NO:116)
Length = 242 residues, 99.6% aligned
Score = 234 bits (598), Expect 2e-62

```
NOV9:   1018 FENHSALEIAEQLTLLDHLVFKKIPYEEFFGQGWMKLEKNERTPY-IMKTTKHFNDISNL  1076
                     |+|||||||  +|+||    |   |   | |   |    +|  + +  + ||++||
00147:     1 LLLLDPKELAEQLTLLDFELFRKIDPSELLGSVWGKRSKKSPSPLNLERFIERFNEVSNW    60

NOV9:   1077 IASEIIRNEDINARVSAIEKWVAVADICRCLHNYNAVLEITSSMNRSAIFRLKKTWLKVS  1136
             +|+||++       |    + |++ ||   ||  |+|+|+++ |  |+++ | | |||||| |+
00147:    61 VATEILKQTTPKDRAELLSKFIQVAKHCRELNNFNSLMAIVSALSSSPISRLKKTWEKLP   120

NOV9:   1137 KQTKALIDKLQKLVSSEGRFKNLREALKNC-DPPCVPYLGMYLTDLAFIEEGTPNYTEDG  1195
               +  |  |  ++|++|+     ||| |||| +|  |||+|+||+ |  ||  ||+||  |++ ++|
00147:   121 SKYKKLFEELEELLDPSRNFKNYREALSSCNLPPCIPFLGVLLKDLTFIDEGNPDFLKNG   180

NOV9:   1196 LVNFSKMRMISHIIREIRQFQQTAYKIEHQAKVTQYLLDQSF--VMDEESLYESSLRIEP  1253
             ||||  |  |  |+ |+|||||  |    | +        |  ||  ||    + +|  |||  ||||||
00147:   181 LVNFEKRRKIAKILREIRQLQSQPYNLRPNRSDIQSLLQQSLDSLPEENELYELSLRIEP   240

NOV9:   1254 K                                                             1254
             +
00147:   241 R                                                              241
```

TABLE 9F

Domain Analysis of NOV9 gnl|Pfam|pfam00617, RasGEF, RasGEF domain. Guanine nucleotide exchange factor for Ras-like small GTPases. (SEQ ID NO:117)
Length = 188 residues, 99.5% aligned
Score = 224 bits (570), Expect = 3e-59

```
NOV9:   1020 NHSALEIAEQLTLLDHLVFKKIPYEEFFGQGWMKL-EKNERTPYIMKTTKHFNDISNLIA  1078
                  ||+|+||||+| +||||    |   || |  |     ||||+|  |  ||  |+||  ++| +
00617:     2 LLDPLELAKQLTLLEHELFKKIDPFECLGQVWGKKYGKNERSPNIDKTIKNFNQLTNFVG    61

NOV9:   1079 SEIIRNEDINARVSAIEKWVAVADICRCLHNYNAVLEITSSMNRSAIFRLKKTWLKVSKQ  1138
               + |+    |     |     |+|++ |||  ||  |+|+|++|  |  |++   |  |+||||||   |   |
00617:    62 TTILLQTDPKKRAELIQKFIQVADHCRELNNFNSLLAIISALYSSPIYRLKKTWQYVPPQ   121

NOV9:   1139 TKALIDKLQKLVSSEGRFKNLREALKNCDP-PCVPYLGMYLTDLAFIEEGTPNYTEDGLV  1197
              +   | ++|  ||+  |+   |  |  ||  ||+   |  ||||+  |+||+||  |+|||  |++  |   ||
00617:   122 SLKLFEELNKLMDSDRNFSNYRELLKSIFPLPCVPFFGVYLSDLTFLEEGNPDFLETNLV   181

NOV9:   1198 NFSKMRM                                                       1204
             |||| |
00617:   182 NFSKRRK                                                        188
```

TABLE 9G

Domain Analysis of NOV9 gnl|Pfam|pfam00621, RhoGEF, RhoGEF domain. Guanine nucleotide exchange factor for Rho/Rac/Cdc42-like GTPases Also called Dbl-homologous (DH) domain. It appears that pfam00169 domains invariably occur C-terminal to RhoGEF/DH domains. (SEQ ID NO:118)
Length = 182 residues, 100.0% aligned
Score = 192 bits (487), Expect = 1e-49

```
NOV9:    244 VVFSMLEAEAEYVQQLHILVNNFLRPLRMAASSKKPPITHDDVSSIFLNSETIMFLHQIF   303
             |+  +||  |  +||+  |  ||||  +++|||  ||  ||  |  +|  ||+ +||  |      |      |+ |
00621:     1 VLKELLETEKKYVRDLEILVNVYMKPLREAAISK-PVLTPDDLETIFSNINEIYEFHREF    59

NOV9:    304 YQGLKARISSWP-TLVLADLFDILLPMLNIYQEFVRNHQYSLQILAHCKQNRDFDKLLKH   362
              + |+ |||| |     | |||  | | | || |+  |  |+ ++|  |   |   | + |
00621:    60 LKSLEDRISSSPSAPRLGDLFLKLEPFLQIYGEYCANKPYAQELLEKCSSNPQFAEFLDE   119

NOV9:    363 YEAKPDCEERTLETFLTYPMFQIPRYILTLHELLAHTPHEHVERNSLDYAKSKLEELSRI   422
              ||  +  + ||++ |  |+ +|||| | | ||| ||| +  +|  |  |   |++|++
```

TABLE 9G-continued

Domain Analysis of NOV9

```
00621:  120  VEASSNTGKLTLQSLLLKPVQRIPRYPLLLKELLKHTPEDQPDREDLKKALDLLQDLAKS  179

NOV9:   423  MHD                                                          425
             +++
00621:  180  INE                                                          182
```

TABLE 9H

Domain Analysis of NOV9 gnl|Smart smart00325, RhoGEF, Guanine nucleotide exchange factor for Rho/Rac/Cdc42-like GTPases; Guanine nucleotide exchange factor for Rho/Rac/Cdc42-like GTPases Also called Dbl-homologous (DH) domain. It appears that PH domains invariably occur C-terminal to RhoGEF/DH domains. Improved coverage. (SEQ ID NO:119)
Length = 181 residues, 100.0% aligned
Score = 139 bits (349), Expect = 1e-33

```
NOV9:   244  VVFSMLEAEAEYVQQLHILVNNFLRPLRMAASSKKPPITHDDVSSIFLNSETIMFLEQIF  303
             |+  +|+  |   ||+  |   |||    ||+||+   |      ++ |+| ++| | |     |+||
00325:    1  VLKELLQTERNYVRDLKILVEVFLKPLKKEAK----LLSPDEVETLFGNIEEIYEFHRIF   56

NOV9:   304  YQGLKARISSWPTLV--LADLFDILLPMLNIYQEFVRNHQYSLQILAHCK-QNRDFDKLL  360
             |+ |+  |        + |+|   |  +  ||  |+ ||   +|++|    |+|+ | | |
00325:   57  LDELEKRVEEWDDSGDRIGDVFLKLEELFKIYSEYCSNHPDALELLKKLKKKNKRFQKFL  116

NOV9:   361  KHYEAKPDCEERTLETFLTYPMFQIPRYILTLHELLAHTPHEHVERNSLDYAKSKLEELS  420
             |  |+ |+|     ||+ |  |+ ++ +|  |  |||  ||| +| +|    |    ++||+
00325:  117  KEIESNPNCRRLELESLLLKPVQRLTKYPLLLKELLKHTPPDHEDREDLKKALDAIKELA  176

N0V9:   421  RIMHD                                                        425
             +++
00325:  177  SQVNE                                                        181
```

TABLE 9I

Domain Analysis of NOV9 gnl|Pfam|pfam00618, RasGEFN, Guanine nucleotide exchange factor for Ras-like GTPases; N-terminal motif. A subset of guanine nucleotide exchange factor for Ras-like small GTPases appear to possess this motif/domain N-terminal to the RasGef (Cdc25-like) domain. (SEQ ID NO:120)
Length = 56 residues, 96.4% aligned
Score = 62.8 bits (151), Expect = 1e-10

```
NOV9:   629 SCKVLQIRYASVERLLERLTDLRFLSIDFLNTFLHSYRVFTTAIVVLDKLITIY  682
            ||  |+ ++| |+| ||||    + |+ ||| +||  |   +|| |+ |
00618:    1 YDKVGSIKGGTLEALIEYLTDLESEDLFFVETFLLTYRSFITTQELLDLLISRY   54
```

TABLE 9J

Domain Analysis of NOV9 gnl|Smart·smart00233, PH, Pleckstrin homology domain.; Domain commonly found in eukaryotic signalling proteins. The domain family possesses multiple functions including the abilities to bind inositol phosphates, and various proteins. PH domains have been found to possess inserted domains (such as in PLC gamma, syntrophins) and to be inserted within other domains. Mutations in Brutons tyrosine kinase (Btk) within its PH domain cause X-linked agammaglobulinaemia (XLA) in patients. Point mutations cluster into the positively charged end of the molecule around the predicted binding site for phosphatidylinositol lipids. (SEQ ID NO:121)
Length = 104 residues, 98.1% aligned
Score = 58.9 bits (141), Expect = 2e-09

```
NOV9:    24  TRKGYLSKRSSDNTK-WQTKWFALLQNLLFYFESD---SSSRPSGLYLLEGCVCDRAPSP   79
             ++|+|  |+||     |  |+ ++|   |   +|  |++|    |||+|  |  ||    ||
00233:    2  IKEGWLLKKSSGGKKSWKKRYFVLFNGVLLYYKSKKKKSSSKPKGSIPLSGCTVREAPDS   61

NOV9:    80  KPALSAKEPLEKQHYFTVNFSHENQKALELRTEDAKDCDEWVAAIAHASYR          130
             +  +|++ | +     ++| | |+  ++   |||  |   +     +
00233:   62  -------DSDKKKNCFEI--VTPDRKTLLLQAESEEERKEWVEALRKAIAK         103
```

The stimulation of a variety of cell surface receptors promotes the accumulation of the active, GTP-bound form of Ras proteins in cells, which is a critical step in signal transduction. To reach the active GTP-bound state, Ras proteins must first release bound GDP. This rate-limiting step in GTP binding is thought to be catalyzed by a guanine-nucleotide-releasing factors (GRF) (Overbeck et. al., Mol. Reprod. Dev., 42:468–476, 1995). The exchange factor Ras-GRF1, also called CDC25 Mm, couples calcium signaling and G-protein-coupled receptors to Ras and downstream effectors. Ras-GRF1 has also been shown to strongly enhance the level of active Ras (Ras-GTP) and the activity of mitogen-activated protein kinases (MAPK) in different cell lines (Zippel et al., Exp. Cell Res. 258:403–408, 2000). The present invention is a novel variant of previously described Ras-GRF1 (Schweighoffer and Tocque,1994, GenSeq: AC R43578) that antagonises the interaction of GDP-exchange factor (GRFs) with the p21-GDP complex and thereby regulates the activity of ras gene products.

The protein similarity information, expression pattern, and map location for the NOV9 suggest that NOV9 may have important structural and/or physiological functions characteristic of the Guanine Nucleotide Releasing protein family. Therefore, the NOV9 nucleic acids and proteins of the invention are useful in potential therapeutic applications implicated in various diseases and disorders described below and/or other pathologies. For example, the NOV9 compositions of the present invention will have efficacy for treatment of patients suffering from myocardial hypertrophy, high-grade gliomas, cancers such as breast cancer, cervical cancer, lung cancer, pancreatic cancer and/or prostate cancer. The NOV9 nucleic acid encoding Guanine Nucleotide Releasing Protein-like protein, and the Guanine Nucleotide Releasing Protein-like protein of the invention, or fragments thereof, may further be useful in diagnostic applications, wherein the presence or amount of the nucleic acid or the protein are to be assessed.

NOV10

A disclosed NOV10 nucleic acid of 748 nucleotides (designated CuraGen Acc. No. 133268995_da1) encoding a novel Interleukin-1-like protein is shown in Table 10A. An open reading frame was identified beginning with an ATG initiation codon at nucleotides 1–3 and ending with a TAG codon at nucleotides 472–474. A putative untranslated region downstream from the termination codon is underlined in Table 10A, and the start and stop codons are in bold letters.

TABLE 10A

| NOV10 Nucleotide Sequence |
|---|
| **ATG**GTCCTGAGTGGGGCGCTGTGCTTCAGAATGAAG (SEQ ID NO:21) |
| GACTCGGCATTGAAGGTGCTTTATCTGCATAATAAC |
| CAGCTTCTAGCTGGAGGGCTGCATGCAGGGAAGGTC |
| TCCCTCCTAGAGAAGATCTGCATACTTCCTAACAGA |
| GGCTTGGCCCGCACCAAGGTCCCCATTTTCCTGGGG |
| ATCCAGGGAGGGAGCCGCTGCCTGGCATGTGTGGAG |
| ACAGAAGAGGGGCCTTCCCTACAGCTGGAGCAGCCA |
| GTGAACATCATGGAGCTCTATCTTGGTGCCAAGGAA |
| TCCAAGAGCTTCACCTTCTACCGGCGGGACATGGGG |

TABLE 10A-continued

| NOV10 Nucleotide Sequence |
|---|
| CTCACCTCCAGCTTCGAGTCGGCTGCCTACCCGGGC |
| TGGTTCCTGTGCACGGTGCCTGAAGCCGATCAGCCT |
| GTCAGACTCACCCAGCTTCCCGAGAATGGTGGCTGG |
| AATGCCCCCATCACAGACTTCTACTTCCAGCAGTGT |
| GAC**TAG**GGCAAC |

The nucleic acid sequence of NOV10 maps to chromosome 2 and has 426 of 480 bases (88%) identical to a *Homo sapiens* interleukin-1 receptor antagonist homolog (IL1HY1) mRNA (gb:GENBANK-ID:AF186094|acc:AF186094.1) (E=$3.9e^{-77}$).

A NOV10 polypeptide (SEQ ID NO:22) encoded by SEQ ID NO:21 is 157 amino acid residues and is presented using the one letter code in Table 10B. Signal P, Psort and/or Hydropathy results predict that NOV10 is likely to be localized extracellularly.

TABLE 10B

| NOV10 protein sequence |
|---|
| MVLSGALCFRMKDSALKVLYLHNNQLLAGGLHAGKV (SEQ ID NO:22) |
| SLLEKICILPNRGLARTKVPIFLGIQGGSRCLACVE |
| TEEGPSLQLEQPVNIMELYLGAKESKSFTFYRRDMG |
| LTSSFESAAYPGWFLCTVPEADQPVRLTQLPENGGW |
| NAPITDFYFQQCD |

The NOV10 amino acid sequence has 131 of 157 amino acid residues (83%) identical to, and 141 of 157 amino acid residues (89%) similar to, a Homo sapiens 155 amino acid residue FIL1 delta (interleukin-1 like protein 1) (interleukin-1 receptor antagonist homolog 1) (interleukin-1 delta) (ptnr:SPTREMBL-ACC:Q9UBH0) (E=$1.3e^{-66}$).

NOV10 is expressed in at least the following tissues: placenta. This information was derived by determining the tissue sources of the sequences that were included in the invention including but not limited to SeqCalling sources, Public EST sources, Genomic Clone sources, Literature sources, and/or RACE sources. In addition, NOV10 is predicted to be expressed in placenta tissues because of the expression pattern of a closely related *Homo sapiens* interleukin-1 receptor antagonist homolog (IL1HY1) mRNA (gb:GENBANK-ID:AF186094|acc:AF186094.1).

NOV10 also has homology to the amino acid sequences shown in the BLASTP data listed in Table 10C.

TABLE 10C

BLAST results for NOV10

| Gene Index/ Identifier | Protein/Organism | Length (aa) | Identity (%) | Positives (%) | Expect |
|---|---|---|---|---|---|
| gi\|6912432\|ref\|NP_036407.1\| (NM_012275) interleukin-1 receptor antagonist homolog 1 [*Homo sapiens*] | similar to VITELLINE MEMBRANE OUTER LAYER PROTEIN I PRECURSOR (VMO-I) (VMOI) (*H. sapiens*) [*Homo sapiens*] | 155 | 131/157 (83%) | 141/157 (89%) | 3e−70 |
| gi\|9506807\|ref\|NP_062324.1\| (NM_019451) interleukin 1 family, member 5 (delta); interleukin 1 receptor antagonist homolog 1 [*Mus musculus*] | VITELLINE MEMBRANE OUTER LAYER PROTEIN I PRECURSOR (VMO-I) (VMOI) [*Gallus gallus*] | 155 | 126/157 (80%) | 139/157 (88%) | 6e−68 |
| gi\|9651791\|gb\|AAF91275.1\|AF230378_1 (AF230378) interleukin-1 delta [*Mus musculus*] | Chain A, Vitelline Membrane Outer Layer Protein I [*Gallus gallus*] | 156 | 126/157 (80%) | 139/157 (88%) | 6e−68 |
| gi\|18025344\|gb\|AAK33010.1\| (AY029413) interleukin-1 receptor antagonist-like FIL1 theta [*Homo sapiens*] | fertilization envelope outer layer protein [*Cyprinus carpio*] | 152 | 84/139 (60%) | 95/139 (67%) | 9e−36 |
| gi\|14573319\|gb\|AAK68048.1\|AF334755_1 (AF334755) interleukin-1 HY2 [*Homo sapiens*] | Y9C9A.1.p [*Caenorhabditis elegans*] | 152 | 82/139 (58%) | 93/139 (65%) | 1e−34 |

The homology of these sequences is shown graphically in the ClustalW analysis shown in Table 10D.

Table 10D ClustalW Analysis of NOV10

1) NOV10 (SEQ ID NO:22)
2) gi 6912432|ref NP_036407.1| (NM_012275) interleukin-1 receptor antagonist homolog 1 [Homo sapiens] (SEQ ID NO:122)
3) gi 9506807|ref NP_062324.1| (NM_019451) interleukin 1 family, member 5 (delta); interleukin 1 receptor antagonist homolog 1 [Mus musculus] (SEQ ID NO:123)
4) gi 9651791|gb AAF91275.1 AF230378_1 (AF230378) interleukin-1 delta [Mus musculus] (SEQ ID NO:124)
5) gi 18025344|gb AAK33010.1 (AY029413) interleukin-1 receptor antagonist-like FIL1 theta [Homo sapiens] (SEQ ID NO:125)

6) gi|14573319|gb|AAK68048.1|AF334755_1 (AF334755) interleukin-1 HY2 [Homo sapiens] (SEQ ID NO:126)

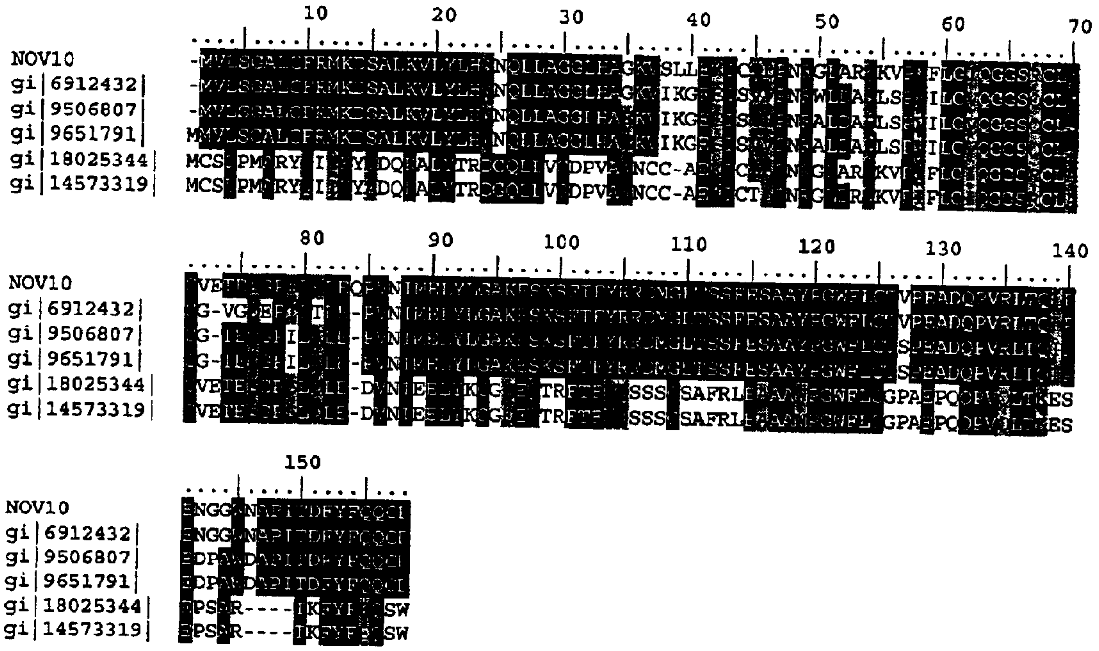

```
                 10        20        30        40        50        60        70
                 ....|....|....|....|....|....|....|....|....|....|....|....|....|....|
NOV10         -MVLSGALCFMKCSALKVLYLHNQLLAGGLFGKVSLLEYCSENEGLARFKVEFLGRQGGSPCL
gi|6912432|   -MVLSGALCFMKCSALKVLYLHNQLLAGGLFGKVIKGESSVFNEWLIALSEFILCVCGGSPCL
gi|9506807|   -MVLSGALCFMKCSALKVLYLHNQLLAGGLHASKVIKGESSVFNFALCALSEFILCVCGGSCCL
gi|9651791|   MVVLSGALCFMKCSALKVLYLHNQLLAGGLHASKVIKGESSVFNGALCALSEFILCVCGGSCCL
gi|18025344|  MCSLPMQRYIEHYEDQHALYTRGGQLIVDPVEANCC-ARFCTHNEGFARFKVEFLGRCGGSPCL
gi|14573319|  MCSLPMQRYIEHYEDQHALYTRGGQLIVDPVEANCC-ARFCTHNEGFARFKVEFLGRCGGSPCL

                 80        90       100       110       120       130       140
                 ....|....|....|....|....|....|....|....|....|....|....|....|....|
NOV10         VETPEREFCPFANIKELVGAKESKSPTFYRPNGLLSSFESAAYEGWFLCTVPEADQPVRLTCH
gi|6912432|   G-VGPEFCPTTLPVNIFEIYLGAKESKSPTYRRDMHLTSSFESAAYEGWFLCTVPEADQPVRLTCH
gi|9506807|   G-IEPHILDLE-EVNIFRIYLGAKESKSPTFYRRDRGLTESFESAAYFGWFLCSPEADQPVRLTCH
gi|9651791|   G-IEPHILDLE-EVNIFRIYLGAKESKSPTFYRRDRGLTESFESAAYFGWFLCSPEADQPVRLTCH
gi|18025344|  VETESPEREALI-DVNIEELKSGFETTRFFTESSSSSAFRLEEAANHGWFLCGPAEPCEVLLTES
gi|14573319|  VETESPEREALI-DVNIEELKSGFETTRFFTESSSSSAFRLEEAANHGWFLCGPAEPCEVLLTES

                150
                ....|....|....
NOV10         ENGGTNAPITDFYFQQCI
gi|6912432|   ENGGTNAPITDFYFQQCI
gi|9506807|   EDPAKDAPITDFYFQQCI
gi|9651791|   EDPAKDAPITDFYFQQCI
gi|18025344|  EPSSR----IKFYIESW
gi|14573319|  EPSSR----IKFYIESW
```

Tables 10E and 10F list the domain description from DOMAIN analysis results against NOV10. This indicates that the NOV10 sequence has properties similar to those of other proteins known to contain these domains.

TABLE 10E

Domain Analysis of NOV10

```
gnl|Smart smart00125, IL1, Interleukin-1 homologues; Cytokines with
various biological functions. Interluekin 1 alpha and beta are also
known as hematopoietin and catabolin. (SEQ ID NO:127)
Length = 148 residues, 96.6% aligned
Score = 123 bits (309), Expect = 7e-30
NOV10:    9 FRMKDSALKVLYLHN-NQLLAGGLHAGKVSLLEKICILPNRGLART-KVPIFLGIQGGSR   66
            ||+ |+  | | | |   | |  |    ++   |  +   +|     |+|+ |||+  +
00125:    6 FRLNDANQKSLVLANPQYLKALHLQGQNLNQEVKFDMSFVQGEEEDSKIPVTLGIKKKNL   65

NOV10:   67 CLACVETEEGPSLQLEQPVNIMELYLGAKESKSFTFYRRDMGLTSSFESAAYPGWFLCTV  126
             |+||+  + |+||||   +  +     +  | | | + ++|  + ||||||| ||+ |
00125:   66 YLSCVKKGDKPTLQLEMV-DPKKYPKNKEMEKRFVFEKHEIGNKNEFESAAYPNWFISTS  124

NOV10:  127 PEADQPVRLTQLPENGGWNAPITDFYFQ                                  154
             | |+|| |   |        ||||  |
00125:  125 QEEDRPVFLGNGPP----GQDITDFQMQ                                  148
```

TABLE 10F

Domain Analysis of NOV10

```
gnl|pFAM|00340, IL1, Interleukin-1/18. This family includes
interleukin-1 and interleukin-18. (SEQ ID NO:128)
Length = 142 residues, 98.6% aligned
Score = 112 bits (280), Expect = 2e-26
NOV10:   11 MKDSALKVLYLHN-NQLLAGGLHAGKVSLLEKICILPNRGLARTKVPIFLGIQGGSRCLA   69
            + |+  | | | | | | |  |+     +   +  +       +|+|+ ||| | +  |+
00340:    1 LNDANQKSLVLANPNYLKALHLNGLNQEVKFDMSFVQG-EPHDSKIPVTLGISGTNLYLS   59

NOV10:   70 CVETEEGPSLQLEQPVNIMELYLGAKESKSFTFYRRDMGLTSSFESAAYPGWFLCTVPEA  129
            ||+  + | ||||      +    ++  | | | + ++|    ||||||| ||+ |  |
00340:   60 CVKEGDEPVLQLEMV-EPPKYIKNSEMDKRFFFEKTEIGSKVYFESAAYPNWFIATKQEE  118

NOV10:  130 DQPVRLTQLPENGGWNAPITDFYFQQ                                    155
            |+|| |   |      + ||||  ++
00340:  119 DRPVFLANGPP----ESDITDFQIEE                                    140
```

Interleukin-1 is a cytokine with a wide range of biological and physiological effects, including fever, prostaglandin synthesis (in e.g., fibroblasts, muscle and endothelial cells), T-lymphocyte activation, and interleukin 2 production. This family is a member of a superfamily that also contains the heparin binding growth factors (HBGF), the Kunitz-type soybean trypsin inhibitors (STI) and histactophilin. All have very similar structures, but although the interleukin-1 and HBGF families share some sequence similarity (about 25%), they show none at all to the STIs. The interleukin-1 family consists of 2 main classes, designated alpha (IL1A) and beta (IL1B), as well as the more recently discovered interleukin 1 receptor antagonist (IL1RA). Sequence similarity is high within the IL1A and IL1B subfamilies (about 60–70%) but low between them (less than 30%). IL1As and IL1Bs are synthesised as larger precursors, which are processed to give mature carboxy fragments. IL1B requires this cleavage to become biologically active, but IL1A precursor is already active. Both IL1A and IL1B bind to the same IL1-specific receptor on the target cell, which is then internalised to initiate the relevant effects. IL1RA binds to the IL1 receptor, blocking the effects of IL1A and IL1B whilst eliciting no response of its own. From sequence comparisons it seems to have arisen by gene duplication before IL1 diverged into IL1A and IL1B. The crystal structures of IL1A and IL1B have been solved, they share the same 12-stranded beta-sheet structure as both the heparin binding growth factors and the Kunitz-type soybean trypsin inhibitors. The beta-sheets are arranged in 3 similar lobes around a central axis, 6 strands forming an anti-parallel beta-barrel. Several regions, especially the loop between strands 4 and 5, have been implicated in receptor binding.

The cytokine interleukin-1 (IL1) elicits a wide array of biologic activities that initiate and promote the host response to injury or infection by activating a set of transcription factors, including NFKB and AP1, which in turn produce production of effectors of the inflammatory response. Using a high-throughput cDNA screening technology and BLAST searching, followed by additional library screenings, RT-PCR, and 5-prime RACE analysis, Mulero et al. (Biochem Biophys Res Commun. 263(3):702–6, 1999) isolated a cDNA encoding a novel member of the interleukin-1 family, which they termed IL1HY1. The deduced 155-amino acid protein shares 52% sequence identity with IL1RA. It contains 3 of 4 highly conserved cysteine residues and an aspartate at position 148, which is cognate to asp145 in IL1B and has been shown to impart agonist activity to IL1B. It does not contain a signal peptide or a prodomain. PCR analysis revealed expression in leukocytes, spleen, and brain as well as in fetal brain and most abundantly in a fetal skin library. RT-PCR analysis also established that IL1HY1 expression is amplified in a stimulated macrophage cell line.

The above defined information for NOV10 suggests that this NOV10 protein may function as a member of a Interleukin-1 protein family. Therefore, the NOV10 nucleic acids and proteins of the invention are useful in potential therapeutic and diagnostic applications. For example, a cDNA encoding the NOV10 protein may be useful in gene therapy, and the NOV10 protein may be useful when administered to a subject in need thereof. By way of nonlimiting example, the compositions of the present invention will have efficacy for treatment of patients suffering from bone metabolism disorder; proinflammatory disorder; immune disorder; inflammatory disease; septic shock; stroke; diabetes; arthritis; intercolitis; pneumonitis; epithelial cell; skin disease; proliferative disorder; skin cancer; melanoma; Kaposi's sarcoma; epithelial cancer; squamous cell carcinoma; bone resorption disorder; osteoporosis; Paget's disease; osteoarthritis; degenerative arthritis; osteogenesis imperfecta; fibrous displasia; hypophosphatasia; bone sarcoma; myeloma bone disorder; osteolytic bone lesion; hypercalcemia; bone mass; bone fragility; bone pain; bone deformity and/or bone fracture. The NOV10 nucleic acid encoding Interleukin-1-like protein, and the Interleukin-1-like protein of the invention, or fragments thereof, may further be useful in diagnostic applications, wherein the presence or amount of the nucleic acid or the protein are to be assessed.

NOV11

A disclosed NOV11 nucleic acid of 1599 nucleotides (designated CuraGen Acc. No. CG56093-01) encoding a novel Interleukin-1 signal transducer-like protein is shown in Table 11A. An open reading frame was identified beginning with an ATG initiation codon at nucleotides 6–8 and ending with a TAG codon at nucleotides 1584–1586. Putative untranslated regions upstream from the initiation codon and downstream from the termination codon are underlined in Table 11A, and the start and stop codons are in bold letters.

TABLE 11A

| NOV11 Nucleotide Sequence |
|---|
| (SEQ ID NO:23) |
| TTACT**ATG**AGTCTGCTAAACTGTGAAAACAGGTGTGGATCCAGCCAGTCTCAAAGTGACTACTGTGTGGCCATGGCCAG |
| CTCCTGTAGCGCAGCAACAAAAAATGATAGTGTGGGCAGAACTGCCAGCACGGGGAACCTCTTCAGCTCCTTTATGGAG |
| GAGATCCAGGGATATGATGTAGAGTTTGGCCCACCCCTGGAAAGCAAGTATGAATGCCCCATCTGCTTGATGGCATTAC |
| GAGAAGCAGTGCAAACGCCATGCAGCCATAGGTTCTGCAAAGCCTGCATCATAAAATCAATAAGGGATGCAGGTCACAA |
| ATATCCAGTTGACAATGAAATACTGCTGGAAAATAAACTATTTCCAGACAATTTTGCAAAACGTGAGATTATTTCTCTG |
| ATAGTGAAGTGTCCAAATGAAGGTTGTTTGCACAAGATGGAACTGAGACATCTTGAGGATCATCAAACACATTGTGAGT |
| TTGCTCTTATGGATTGTCCCCAATGCCAGCCTCCCTTCCAAAAATTCCATATTAATATTTACATTATGAAGGGTTGTCC |
| AAGGAGGCAGGTATCTTGTGACAACTGTGCTGCATCAATGGCATTTGAAGATAAAAAGATCCATGACCAGAACTGCCCT |
| TTGGCAAATGTCATCTGTGAGTACTGCAATACTATACTCATCAGAGAACAGATGCCTAACTTTATGACCTATGACCTAG |
| ACCGCCCTACAGCCCCAATTCCATGCACATTCCGTACTTTTCGTAGCCATGAAAAGATGCGGAGGAATCACTTGGCACG |
| CCACCTACAAGAGAACACCCAATCAAACATGAGAATGTTGGCCCAGGCTGTTCATAGTTTGAGCCTTATACCCGACTCT |
| GGGTATATCTCAGAGGTCCGGAATTTCCAGGAAAGTATTCACCAGTTAGAGGGTCGCCTTGTAAGACAATGTCATCAAA |
| TCCGGGAGCTGACTGATAAAATGGAAACTCAGAGTATGTATGTAAGTGAGCTCAAACGAACCATTCGAACCCTTGAGGA |
| CAAAGTTGCTGAAATTGAAGCACAGCAGTGCAATGGAATTTACATTTGGAAGATTGGGAATGAATTTGAAATGTTAAGA |
| AGAGCAGAAACCGAAGAGCAGAAACCTGTTGTGATTCATAGCCCTGGATTCTACACGGGTAAACACAGGTACAAACTGT |
| GCATGCGCTTGCACCTTCCGTTACCGACTGCTCAGCGCTGTGCAAACTATATATCCCTTTTTGTCCACACAATGCAAGG |
| AGAGTATGACAGCCACCTCCCTTGGCCCTTCCAGGATACAATATGCCTTACAATTCTTGATCAGTCTCAAGCACCTGTA |
| AGGCAAAACCACGAAGAGATAATGGATGCCAAACCAGAGCTGCTTGCTTTCCAGCGACCCACAATCCCACGGAACCCAA |
| AAGGTTTTGGCTATGTAACTTTTATGCATCTGGAAGCCCTAAGACAAAGAACTTTCATTAAGGATGACACATTATTAGT |
| GCACTGTGAGGTCTCCACCCGCTTTGACATGGATAGCCTTCAGAGGGAGGGTTTTCAGCCACAAAGTACTGATGCAGGG |
| GTATAGCTTGCCCTCACTT |

The nucleic acid sequence of NOV11 maps to chromosome 10 and has 712 of 856 bases (83%) identical to a *Mus musculus* TRAF6 mRNA (gb:GENBANK-ID:D84655|acc:D84655.1) (E=$3.0e^{-242}$).

A NOV11 polypeptide (SEQ ID NO:24) encoded by SEQ ID NO:23 is 526 amino acid residues and is presented using the one letter code in Table 11B. Signal P, Psort and/or Hydropathy results predict that NOV11 is likely to be localized extracellularly with a certainty of 0.5050.

TABLE 11B

| NOV11 protein sequence |
|---|
| (SEQ ID NO:24) |
| MSLLNCENRCGSSQSQSDYCVAMASSCSAATKNDSVGRTASTGNLFSSFMEEIQGYDVEFGPPLESKYECPICLMALREAVQT |
| PCSHRFCKACIIKSIRDAGHKYPVDNEILLENKLFPDNFAKREIISLIVKCPNEGCLHKMELRHLEDHQTHCEFALMDCPQCQ |
| PPFQKFHINIYIMKGCPRRQVSCDNCAASMAFEDKKIHDQNCPLANVICEYCNTILIREQMPNFMTYDLDRPTAPIPCTFRTF |
| RSHEKMRRNHLARHLQENTQSNMRMLAQAVHSLSLIPDSGYISEVRNFQESIHQLEGRLVRQCHQIRELTDKMETQSMYVSEL |
| KRTIRTLEDKVAEIEAQQCNGIYIWKIGNEFEMLRRAETEEQKPVVIHSPGFYTGKHRYKLCMRLHLPLPTAQRCANYISLFV |
| HTMQGEYDSHLPWPFQDTICLTILDQSQAPVRQNHEEIMDAKPELLAFQRPTIPRNPKGFGYVTFMHLEALRQRTFIKDDTLL |
| VHCEVSTRFDMDSLQREGFQPQSTDAGV |

The NOV11 amino acid sequence has 475 of 526 amino acid residues (90%) identical to, and 493 of 526 amino acid residues (93%) similar to, a *Homo sapiens* 522 amino acid residue putative Interleukin 1 signal transducer (ptnr:SPTREMBL-ACC:Q9Y4K3) ($E=1.2e^{-263}$).

NOV11 also has homology to the amino acid sequences shown in the BLASTP data listed in Table 11C.

TABLE 11C

BLAST results for NOV11

| Gene Index/Identifier | Protein/Organism | Length (aa) | Identity (%) | Positives (%) | Expect |
|---|---|---|---|---|---|
| gi\|4759254\|ref\|NP_004611.1\| (NM_004620) | TNF receptor-associated factor 6 [*Homo sapiens*] | 522 | 475/526 (90%) | 493/526 (93%) | 0.0 |
| gi\|7513262\|pir\|\|S71821 | probable interleukin 1 signal-transducing protein TRAF6 [*Homo sapiens*] | 522 | 474/526 (90%) | 492/526 (93%) | 0.0 |
| gi\|6678429\|ref\|NP_033450.1\| (NM_009424) | Tnf receptor-associated factor 6 [*Mus musculus*] | 530 | 426/534 (79%) | 467/534 (86%) | 0.0 |
| gi\|17472113\|ref\|XP_061503.1\| (XM_061503) | similar to TNF receptor-associated factor 6 [*Homo sapiens*] | 399 | 235/271 (86%) | 236/271 (86%) | e−131 |
| gi\|17472115\|ref\|XP_061504.1\| (XM_061504) | similar to TNF receptor-associated factor 6 [*Homo sapiens*] | 225 | 114/115 (99%) | 115/115 (99%) | 4e−60 |

The homology of these sequences is shown graphically in the ClustalW analysis shown in Table 11D.

Table 11D ClustalW Analysis of NOV11

1) NOV11 (SEQ ID NO:24)

2) gi|4759254|ref|XP_004611.1| (NM_004620) TNF receptor-associated factor 6 [Homo sapiens] (SEQ ID NO:129)

3) gi|7513262|pir||S71821 probable interleukin 1 signal-transducing protein TRAF6 [Homo sapiens] (SEQ ID NO:130)

4) gi|6678429|ref|XP_033450.1| (NM_009424) Tnf receptor-associated factor 6 [Mus musculus] (SEQ ID NO:131)

5) gi|17472113|ref|XP_061503.1| (XM_061503) similar to TNF receptor-associated factor 6[Homo sapiens] (SEQ ID NO:132)

6) gi|17472115|ref|XP_061504.1| (XM_061504) similar to TNF receptor-associated factor 6 [Homo sapiens] (SEQ ID NO:133)

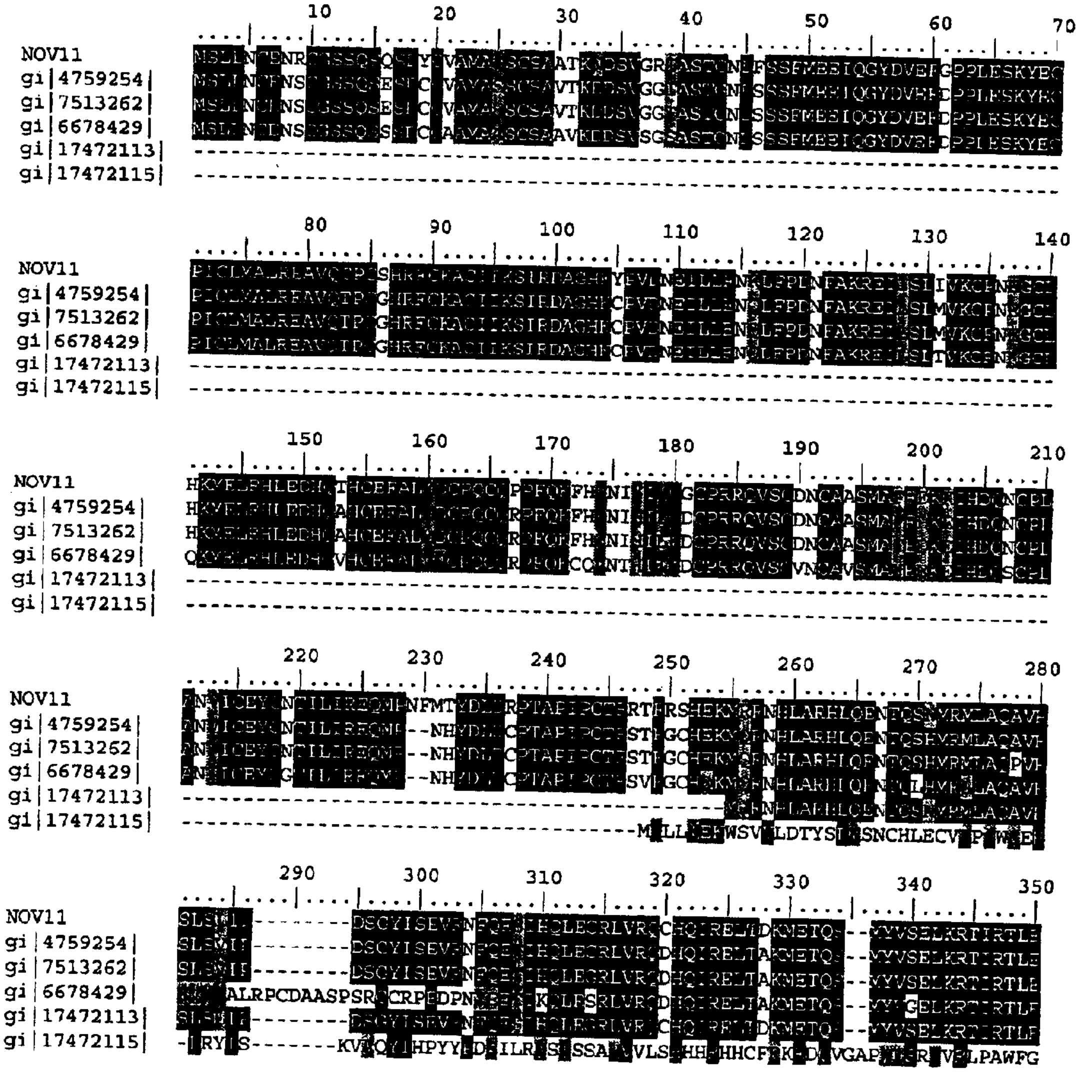

```
                    360       370       380       390       400       410       420
            ....|....|....|....|....|....|....|....|....|....|....|....|....|....|
NOV11       DKVAEIEAQQCNGIYIWKIGNSGELRKAATEEKPVVIHSPGFYTGKHRGYKLCMRLHLPLPTAQRCANN
gi|4759254| DKVAEIEAQQCNGIYIWKIG-NFGMHLKCQ-EEKPVVIHSPGFYTGKPGYKLCMRLHLQLPTAQRCANN
gi|7513262| DKVAEIEAQQCNGIYIWKIG-NFGMHLKCQ-EEKPVVIHSPGFYTGKPGYKLCMRLHLQLPTAQRCANN
gi|6678429| DKVAEIEAQQCNGIYIWKIG-NFGMHLKSQ-EEKPVVIHSPGFYTGKPGYKLCMRLHLQLPTAQRCANN
gi|17472113| DKVAEIEAQQCNGIYIWKIGNSGE-----------------PGFYTGKHRGYKLCMRLHLPLPTAQRCANN
gi|17472115| RPPRASERASDNQCTISLCN--CEN-----------------RCGPSHSQSDYCRARASSCSAPTPND--

                    430       440       450       460       470       480       490
            ....|....|....|....|....|....|....|....|....|....|....|....|....|
NOV11       ISLFVHTMQGEYDSHLPWPFQDTICLTILDQSEAPVRQNHEEMVDAKPELLAFQRPTIPRNPKGFGYVTF
gi|4759254| ISLFVHTMQGEYDSHLPWPFQGTIRLTILDQSEAPVRQNHEEIMDAKPELLAFQRPTIPRNPKGFGYVTF
gi|7513262| ISLFVHTMQGEYDSHLPWPFQGTIRLTILDQSEAPVRQNHEEIMDAKPELLAFQRPTIPRNPKGFGYVTF
gi|6678429| ISLFVHTMQGEYDSHLPWPFQGTIRLTILDQSNLPVRQNHEEVMDAKPELLAFQRPTIPRNPKGFGYVTF
gi|17472113| ISLFVHTMQGEYDSHLPWPFQDTICLTILDQSEAP------------------RPTIPRNPKGFGYVTF
gi|17472115| -SPGRTASTCNLFPSFMEEIRK------YTVEFGR-----------------------PLPSG---QECP

                    500       510       520       530       540       550       560
            ....|....|....|....|....|....|....|....|....|....|....|....|....|
NOV11       MHLEALRQRTFIKDDTLLVHCEVSTRFDMDSLQREGFQPRSTDACV------------------------
gi|4759254| MHLEALRQRTFIKDDTLLVRCEVSTRFDMGSLRREGFQPRSTDACV------------------------
gi|7513262| MHLEALRQRTFIKDDTLLVRCLVSTRFDMGSLRREGFQPRSTDAGV------------------------
gi|6678429| MHLEALRQGTFIKDDTLLVRCEVSTRFDMGGLRREGFQPRSTDAGV------------------------
gi|17472113| MHLEALRQRTFIKDDTLLVHCLVSTRFDMDSLRREGFQPRSTDACYTEKGLDGPELKLGCTELLSKKKQT
gi|17472115| SCPMAGPRA---------PWTPCPHRPCKACLIRS-----IRDAAHKY-----P-----------VDNEI

                    570       580       590       600       610       620       630
            ....|....|....|....|....|....|....|....|....|....|....|....|....|
NOV11       ----------------------------------------------------------------------
gi|4759254| ----------------------------------------------------------------------
gi|7513262| ----------------------------------------------------------------------
gi|6678429| ----------------------------------------------------------------------
gi|17472113| LMQKSIPHTSPHKHVSVVAPVPLSPKIVCIYWALILQSNEVTITEDKFNNLIKAAAVTVEPFWPSFFAKA
gi|17472115| LLEN------------------------------------------------------------------

                    640       650       660       670       680       690
            ....|....|....|....|....|....|....|....|....|....|....|....|...
NOV11       -------------------------------------------------------------------
gi|4759254| -------------------------------------------------------------------
gi|7513262| -------------------------------------------------------------------
gi|6678429| -------------------------------------------------------------------
gi|17472113| LASVNIGSLLCNAGVGRWLQQPAPHKQEVLPLPPLLPQLRRGKWKQKKKNLRSLTRTWALVFLTKLVL
gi|17472115| -------------------------------------------------------------------
```

Tables 11E–11H list the domain description from DOMAIN analysis results against NOV11. This indicates that the NOV11 sequence has properties similar to those of other proteins known to contain these domains.

Many cytokines signal through different cell-surface receptors to activate the transcription factor NF-kappaB. Members of the TRAF protein family have been implicated in the activation of NF-kappaB by the tumour-necrosis factor (TNF)-receptor superfamily. Here we report the identification of a new TRAF family member, designated TRAF6. When overexpressed in human 293 cells, TRAF6 activates NF-kappaB. A dominant-negative mutant of TRAF6 inhibits NF-kappaB activation signalled by interleukin-1 (IL-1) but not by TNF. IL-1 treatment of 293 cells induces the association of TRAF6 with IRAK, a serine/threonine kinase that is rapidly recruited to the IL-1 receptor after IL-1 induction. These findings indicate that TRAF proteins may function as signal transducers for distinct receptor families and that TRAF6 participates in IL-1 signalling. The transcription factor NF-kappa-B is activated by many cytokines that signal through different cell surface receptors. Members of the TRAF protein family have been implicated in the activation of this transcription factor by the tumor necrosis factor (TNF) superfamily. TRAF2 is required for activation of this transcription factor by 2 TNF receptors, TNFR1 and TNFR2, as well as CD40, and TRAF5 may be

TABLE 11E

Domain Analysis of NOV11 gnl|Pfam|pfam00917, MATH, MATH domain. This motif has been called the Meprin and TRAF-Homology (MATH) domain. This domain is hugely expanded in the nematode C. elegans. (SEQ ID NO:134)
Length = 116 residues, 91.4% aligned
Score = 66.2 bits (160), Expect = 4e-12

```
NOV11:  375 KPVVIHSPGFYTGKHRYKLCMRLHLPLPTAQRCANYISLFVHTMQGEYDSHLPWPFQDTI  434
            |    +       +      +|++       |   ++ |++| ++|| ||+| |  +
00917:    9 KEGEEYYSTPVEERFGIPWRLRIY-------RNGGFLGLYHCLKGEKDSNLKWSIEAEF   61

NOV11:  435 CLTILDQSQAPVRQNHEEIMDAKPELLAFQRPTIPRNPKGFGYVTFMHLEALTQRTFIKD  494
             | ++  +   + +  + + +                | | |+  |+  +  |    ++ |
00917:   62 TLKLVSDNGKSLTKKPKHVFE---------------KPTGEGWGKFISWDDLEDD-VLYD  105

NOV11:  495 DTLLVHCEV                                                     503
            |||++  ||
00917:  106 DTLIIEAEV                                                     114
```

TABLE 11F

Domain Analysis of NOV11 gnl|Pfam|pfam02176, zf-TRAF, TRAF-type zinc finger. (SEQ ID NO:135)
Length = 57 residues, 100.0% aligned
Score = 37.0 bits (84), Expect = 0.003

```
NOV11:  151 HQTHCEFALMDCPQ-CQPPFQKFHINIYIMKGCPRRQVSCDNCAASMAFEDKKIHDQ  206
            |+  | |  + ||  |     +  +  ++   ||+| | |         +  + + |
02176:    1 HEKTCPFVPVPCPNKCGKKILREDLPDHLSADCPKRPVPCPFKVYGCKVDMVRENLQ   57
```

TABLE 11G

Domain Analysis of NOV11 gnl|Smartsmart00061, MATH, meprin and TRAF homology (SEQ ID NO:136)
Length = 100 residues, 98.0% aligned
Score = 39.3 bits (90), Expect = 6e-04

```
NOV11:  356 IWKIGNEFEMLRRAETEEQKPVVIHSPGFYTGKHRYKLCMRLHLPLPTAQRCANYISLFV  415
                 |   + +  | |        ||        + +  || +      |   ++||++
00061:    3 SHTFKN---VSKFEEGES-----YFSPSEE----HFNIPWRLKI-----YRKNGFLSLYL   45

NOV11:  416 HTMQGEYDSHLPWPFQDTICLTILDQSQAPVRQNHEEIMDAKPELLAFQRPTIPRNPKGF  475
            |  + | ||   |  +    | ++ |+   + +    +         |++|       |+
00061:   46 HCEKEENDS-RKWSIEAEFTLKLVSQNGKSLSKKDTHV---------FEKPG------GW   89

NOV11:  476 GYVTFMHLEAL                                                   486
            |+  |+  + |
00061:   90 GFSKFISWDDL                                                   100
```

TABLE 11H

Domain Analysis of NOV11 gnl|Smartsmart00184, RING, Ring finger; E3 ubiquitin-protein ligase activity is intrinsic to the RING domain of c-Cbl and is likely to be a general function of this domain; Various RING finger exhibit binding activity towards E2 ubiquitin-conjugating enzymes (Ubc's)(SEQ ID NO:137)
Length = 41 residues, 87.8% aligned
Score = 35.4 bits (80), Expect = 0.008

```
NOV11:   70 CPICLMAL-REAVQTPCSHRFCKACIIKSIRDAGHK 104
            |||||    ++ |  || | ||++|| | +  +
00184:    1 CPICLEEYLKDPVVLPCGHTFCRSCIRKWLESSNSN  36
```

responsible for NF-kappa-B activation signaled by the lymphotoxin B receptor. Cao et al. (Nature. 383(6599):443–6, 1996) identified a new member of the TRAF family, designated TRAF6. When overexpressed in cultured human cells, TRAF6 activates NF-kappa-B. A dominant-negative mutant of TRAF6 inhibited this activation signaled by interleukin-1. IL1A treatment of the same cells induced the association of TRAF6 with interleukin-1-associated kinase, a serine/threonine kinase that is rapidly recruited to the IL1A receptor after IL1A induction. The findings were interpreted as indicating that TRAF proteins function as signal transducers for distinct receptor families in that TRAF6 participates in IL1A signaling. TRANCE (or RANKL), a TNF family member, and its receptor, RANK, are critical regulators of dendritic cell and osteoclast function. Wong et al. (Mol Cell. 4(6):1041–9, 1999) demonstrated that TRANCE activates the antiapoptotic serine/threonine kinase PKB through a signaling complex involving SRC and TRAF6. A deficiency in SRC or addition of SRC family kinase inhibitors blocked TRANCE-mediated PKB activation in osteoclasts. SRC and TRAF6 interacted with each other and with RANK upon receptor engagement. TRAF6, in turn, enhanced the kinase activity of SRC, leading to tyrosine phosphorylation of downstream signaling molecules such as CBL. These results defined a mechanism by which TRANCE activates SRC family kinases and PKB, and provided evidence of cross-talk between TRAF proteins and SRC family kinases. TRAF6 is a signal transducer in the NF-kappa-B pathway that activates I-kappa-B kinase in response to proinflammatory cytokines. Deng et al. (Cell.;103(2):351–61, 2000) purified a heterodimeric protein complex that links TRAF6 to IKK activation. Peptide mass fingerprinting analysis revealed that this complex is composed of the ubiquitin conjugating enzyme UBC13 and the UBC-like protein UBE2V1. They found that TRAF6, a RING domain protein, functions together with UBC13/UBE2V1 to catalyze the synthesis of unique polyubiquitin chains linked through lysine-63 (K63) of ubiquitin. Blockade of this polyubiquitin chain synthesis, but not inhibition of the proteasome, prevents the activation of IKK by TRAF6. These results unveil a new regulatory function for ubiquitin, in which IKK is activated through the assembly of K63-linked polyubiquitin chains. Takayanagi et al. (Nature. 408(6812):600–5, 2000) demonstrated that T-cell production of interferon-gamma strongly suppresses osteoclastogenesis by interfering with the RANKL-RANK signaling pathway. IFNG induces rapid degradation of the RANK adapter protein, TRAF6, resulting in strong inhibition of the RANKL-induced activation of the transcription factor NFKB and JNK. This inhibition of osteoclastogenesis could be rescued by overexpressing TRAF6 in precursor cells, indicating that TRAF6 is the target critical for the IFNG action. Furthermore, Takayanagi et al. (2000) provided evidence that the accelerated degradation of TRAF6 requires both its ubiquitination, which is initiated by RANKL, and IFNG-induced activation of the ubiquitin-proteasome system. Takayanagi et al. (2000) concluded that their study showed that there is crosstalk between the tumor necrosis factor and IFN families of cytokines, through which IFNG provides a negative link between T-cell activation and bone resorption.

The above defined information for NOV11 suggests that this NOV11 protein may function as a member of a Interleukin-1 signal transducer protein family. Therefore, the NOV11 nucleic acids and proteins of the invention are useful in potential therapeutic and diagnostic applications. For example, a cDNA encoding the NOV11 protein may be useful in gene therapy, and the NOV11 protein may be useful when administered to a subject in need thereof. By way of nonlimiting example, the compositions of the present invention will have efficacy for treatment of patients suffering from bone metabolism disorder; proinflammatory disorder; immune disorder; inflammatory disease; septic shock; stroke; diabetes; arthritis; intercolitis; pneumonitis; epithelial cell; skin disease; proliferative disorder; skin cancer; melanoma; Kaposi's sarcoma; epithelial cancer; squamous cell carcinoma; bone resorption disorder; osteoporosis; Paget's disease; osteoarthritis; degenerative arthritis; osteogenesis imperfecta; fibrous displasia; hypophosphatasia; bone sarcoma; myeloma bone disorder; osteolytic bone lesion; hypercalcemia; bone mass; bone fragility; bone pain; bone deformity and/or bone fracture. The NOV11 nucleic acid encoding Interleukin-1 signal transducer-like protein, and the Interleukin-1 signal transducer-like protein of the invention, or fragments thereof, may further be useful in diagnostic applications, wherein the presence or amount of the nucleic acid or the protein are to be assessed.

NOV12

A disclosed NOV12 nucleic acid of 1097 nucleotides (designated CuraGen Acc. No. CG56138-01) encoding a novel Olfactory receptor/G-Protein Coupled Receptor-like protein is shown in Table 12A. An open reading frame was identified beginning with an ATG initiation codon at nucleotides 5–7 and ending with a TAG codon at nucleotides 959–961. Putative untranslated regions upstream from the initiation codon and downstream from the termination codon are underlined in Table 12A, and the start and stop codons are in bold letters.

TABLE 12A

| NOV12 Nucleotide Sequence |
| --- |
| (SEQ ID NO:25) |
| AGTC**ATG**TGCTCAGGGAATCAGACTTCTCAGAATCAAACAGCAAGCACTGATTTCACCCTCACGGGACTCTTTGCTGAG |
| AGCAAGCATGCTGCCCTCCTCTACACCGTGACCTTCCTTCTTTTCTTGATGGCCCTCACTGGGAATGCCCTCCTCATCC |
| TCCTCATCCACTCAGAGCCCCGCCTCCACACCCCCATGTACTTCTTCATCAGCCAGCTCGCGCTCATGGATCTCATGTA |
| CCTATGCGTGACTGTGCCCAAGATGCTTGTGGGCCAGGTCACTGGACATGATACCATTTCCCCGTCAGGCTGTGGGATC |
| CAGATGTTCTTCTACCTGACCCTGGCTGGAGCTGAGGTTTTCCTCCTGGCTGCCATGGCCTATGACCGATATGCTGCTG |
| TTTGCAGACCTCTCCATTACCCACTGCTGATGAACCAGAGGGTGTGCCAGCTCCTGGTGTCAGCCTGCTGGGTTTTGGG |
| AATGGTTGATGGTTTGTTGCTCACCCCCATTACCATGAGCTTCCCCTTTTGCCAGTCTAGGAAAATCCTGAGTTTTTTC |

TABLE 12A-continued

| NOV12 Nucleotide Sequence |
|---|
| TGTGAGACTCCTGCCCTGCTGAAGCTCTCCTGCTCTGACGTCTCCCTCTATAAGACGCTCATGTACCTGTGCTGCATCC |
| TCATGCTTCTCGCCCCCACCATGGTCATCTCCAGCTCATACACCCTCATCCTGCATCTCATCCACAGGATGAATTCTGC |
| CGCCGGCCACAGGAAGGCCTTGGCCACCTGCTCCTCCCACATGATCATAGTGCTGCTGCTCTTCGGTGCTTCCTTCTAC |
| ACCTACATGCTCCCGAGTTCCTACCACACAGCTGAGCAGGACATGATGGTGTCTGCCTTTTACACCATCTTCACTCCTG |
| TGCTGAACCCCCTCATTCACAGTCTCCGCAACAAAGATGTCACCAGGGCTCTGAGGAGCATGATGCAGTCAAGAATGAA |
| CCAAGAAAAG**TAG**TAAAGGGCAAGCATTGTCCCCTCCTCTTTCTATAATTCCGTTACTCCCTATCTCTCCTCTCTTTG |
| CCCTCAGGTCTCCGGGTCCCCAGCACAAAGCCCACTCATATTTTCCTTCTTTCTTATACGTGGCGTTTTC |

The nucleic acid sequence of NOV12 has 548 of 903 bases (60%) identical to a *Gallus gallus* cor4 DNA for olfactory receptor 4 mRNA (gb:GENBANK-ID:GGCOR4GEN|acc:X94744.1) (E=2.5e$^{-41}$).

A NOV12 polypeptide (SEQ ID NO:26) encoded by SEQ ID NO:25 is 318 amino acid residues and is presented using the one letter code in Table 12B. Signal P, Psort and/or Hydropathy results predict that NOV12 contains a signal peptide and is likely to be localized at the plasma membrane with a certainty of 0.6000. The most likely cleavage site for a NOV12 peptide is between amino acids 56 and 57, at: IHS-EP.

TABLE 12B

| NOV12 protein sequence |
|---|
| (SEQ ID NO:26) |
| MCSGNQTSQNQTASTDFTLTGLFAESKHAALLYTVTFLLFLMALTGNALLILLIHSEPRLHTPMYFFISQLALMDLMYLCVTV |
| PKMLVGQVTGDDTISPSGCGIQMFFYLTLAGAEVFLLAAMAYDRYAAVCRPLHYPLLMNQRVCQLLVSACWVLGMVDGLLLTP |
| ITMSFPFCQSRKILSFFCETPALLKLSCSDVSLYKTLMYLCCILMLLAPTMVISSSYTLILHLIHRMNSAAGHRKALATCSSH |
| MIIVLLLFGASFYTYMLPSSYHTAEQDMMVSAFYTIFTPVLNPLIHSLRNKDVTRALRSMMQSRMNQEK |

The NOV12 amino acid sequence has 142 of 297 amino acid residues (47%) identical to, and 194 of 297 amino acid residues (65%) similar to, a *Mus musculus* 316 amino acid residue T2 olfactory receptor (ptnr:TREMBLNEW-ACC:AAG45196) (E=9.3e$^{-73}$).

NOV12 is expressed in at least the following tissues: Apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, tissues that express MHC II and III, nervous, medulla, subthalamic nucleus, ovary, pancreas, pituitary, placenta, pons, prostate, putamen, serum, skeletal muscle, small intestine, smooth muscle (coronary artery in aortic) spinal cord, spleen, stomach, taste receptor cells of the tongue, testis, thalamus, and thymus tissue. This information was derived by determining the tissue sources of the sequences that were included in the invention including but not limited to SeqCalling sources, Public EST sources, Literature sources, and/or RACE sources.

NOV12 also has homology to the amino acid sequences shown in the BLASTP data listed in Table 12C.

TABLE 12C

BLAST results for NOV12

| Gene Index/ Identifier | Protein/Organism | Length (aa) | Identity (%) | Positives (%) | Expect |
|---|---|---|---|---|---|
| gi\|17437056\|ref\|XP_060314.1\| (XM_060314) | similar to OLFACTORY RECEPTOR 2T1 (OLFACTORY RECEPTOR 1-25) (OR1-25) [*Homo sapiens*] | 695 | 308/312 (98%) | 311/312 (98%) | e−153 |

TABLE 12C-continued

| BLAST results for NOV12 | | | | | |
|---|---|---|---|---|---|
| Gene Index/ Identifier | Protein/Organism | Length (aa) | Identity (%) | Positives (%) | Expect |
| gi\|17437027\|ref\|XP_060309.1\| (XM_060309) | similar to olfactory receptor [*Homo sapiens*] | 318 | 310/318 (97%) | 312/318 (97%) | e−147 |
| gi\|17437021\|ref\|XP_060308.1\| (XM_060308) | similar to OLFACTORY RECEPTOR 2T1 (OLFACTORY RECEPTOR 1-25) (OR1-25) [*Homo sapiens*] | 365 | 203/301 (67%) | 238/301 (78%) | e−102 |
| gi\|17437059\|ref\|XP_060315.1\| (XM_060315) | similar to OLFACTORY RECEPTOR 2T1 (OLFACTORY RECEPTOR 1-25) (OR1-25) [*Homo sapiens*] | 348 | 202/301 (67%) | 237/301 (78%) | e−101 |
| gi\|15293809\|gb\|AAK95097.1\| (AF399612) | olfactory receptor [*Homo sapiens*] | 217 | 211/217 (97%) | 212/217 (97%) | 2e−97 |

The homology of these sequences is shown graphically in the ClustalW analysis shown in Table 12D.

Table 12D ClustalW Analysis of NOV12

1) NOV12 (SEQ ID NO:26)
2) gi 17437056|ref XP_060314.1| (XM_060314) similar to OLFACTORY RECEPTOR 2T1 (OLFACTORY RECEPTOR 1-25) (OR1-25) [Homo sapiens] (SEQ ID NO:138)
3) gi 17437027|ref XP_060309.1| (XM_060309) similar to olfactory receptor [Homo sapiens] (SEQ ID NO:139)
4) gi 17437021|ref XP_060308.1| (XM_060308) similar to OLFACTORY RECEPTOR 2T1 (OLFACTORY RECEPTOR 1-25) (OR1-25) [Homo sapiens] (SEQ ID NO:140)
5) gi 17437059|ref XP_060315.1| (XM_060315) similar to OLFACTORY RECEPTOR 2T1 (OLFACTORY RECEPTOR 1-25) (OR1-25) [Homo sapiens] (SEQ ID NO:141)
6) gi 15293809|gb AAK95097.1 (AF399612) olfactory receptor [Homo sapiens] (SEQ ID NO:142)

10 20 30 40 50 60 70

```
             ....|....|....|....|....|....|....|....|....|....|....|....|....|....|
NOV12        ---------------------------MCSSNQTSQNQTASFDTTTTGEFASSHAPPLYTPTPRSFLMA
gi|17437056| ---------------------------MCSSNQTSQNQTASFDTTTTGEFASSHAPPLYTPTPRSFLMA
gi|17437027| ---------------------------MCSSNQTSQNQTASFDTTTTGEFASSHAPPLYTPTPRSFLMA
gi|17437021| -----------------------------------MANHTGRLDTIEMGLIRRSSKIPALLSVLIRSFLKG
gi|17437059| MDNITWMASHTGWSDFILMGLFRQSKHPMANITWMANHTGWSDFILLGLIRRSSKHPALLCVLIRSFLMA
gi|15293809| ----------------------------------------------------------------------

                     80        90       100       110       120       130       140
             ....|....|....|....|....|....|....|....|....|....|....|....|....|....|
NOV12        LGNAGLILLIHSDPRLHTPMYFFISQLSLMDLMYLCVTVPKMLVGQVTGDDTISPSGCGIQMFFYLTLA
gi|17437056| LGNAGLILLIHSDPRLHTPMYFFISQLSLMDLMYLCVTVPKMLVGQVTGDDTISPSGCGIQMFFYLTLA
gi|17437027| LGNAGLILLIHSDPRLHTPMYFFISQLSLMDLMYLCVTVPKMLVGQVTGDDTISPSGCGIQMFFYLTLA
gi|17437021| LGNAGLILLIHCDAHLHTPMYFFISQLSLMDLAYLSVTVPKMLLDQVMGVLKGNAPECGIQNFLYLTLA
gi|17437059| LGNAGLILLIHCDAHLHTPMYFFISQLSLMDLAYLSVTVPKMLLDQVMGVLKIAAPECGIQMFFYLTLA
gi|15293809| -----------------------------LMDLMYLCVIVPKMLVGQVTGDDTISPSGCGIQMFFYLTLA

                    150       160       170       180       190       200       210
             ....|....|....|....|....|....|....|....|....|....|....|....|....|....|
NOV12        CAEVFLLAAMAYDRYAAVCRPLHYPLLMNQRVCQLLVSACWVLGMVDGLLLTPITMSFPFCQSRKILSFF
gi|17437056| CAEVFLLAAMAYDRYAAVCRPLHYPLLMNQRVCQLLVSACWVLGMVDGLLLTPITMSFPFCQSRKILSFF
gi|17437027| CAEVFLLAAMAYDRYAAVCRPLHYPLLMNQRVCQLLVSACWVLGMVDGLLLTPITMSFPFCQSRKILSFF
gi|17437021| CTEFFLLATMAYDRYVAVCHPLRYPTLMNHRVCLFLASGCWFLGSVDGFTLTPITMSFPFCRSWEIHHFF
gi|17437059| CAEFFLLATMAYDRYVAVCHPLRYPTLMNHRVCLFLSSGCWFLGSVDGFTLTPITMSFPFRGSWEIHHFF
gi|15293809| CAEVFLLAAMAYDRYAAVCRPLHYPLLMNQRVCQLLVSACWVLGMVDGLLLTPITMSFPFCQSRKILSFF

                    220       230       240       250       260       270       280
             ....|....|....|....|....|....|....|....|....|....|....|....|....|....|
NOV12        CETPALLKLSCSDVSLYKTLMYLCCILMLLAPIMVISSSYTLILHLIHRMNSAAGRKKALATCSSHMIIV
gi|17437056| CETPALLKLSCSDVSLYKTLMYLCCILMLLAPIMVISSSYTLILHLIHRMNSAAGRKKALATCSSHMIIV
gi|17437027| CETPALLKLSCSDVSLYKMLTYLCCILMLLTPIMVISSSYTLILHLIHRMNSAAGRRKALATCSSHMIIV
gi|17437021| CEVFATIKLSCSDTSLYKTLMYLCCILMLLIPLTIISSSYLLIILTVFRMNSAEGFKKAFATCSSHLTVV
gi|17437059| CEVFAMINLSCSDTSLYKIFMYLCCILMLLIPVMIISSSYLLIILTIIGMNSPEGFKKAFATCSSHLTVV
gi|15293809| CETPALLKLSCSDVSLYKMLTYLCCILMLLTPIMVISSSYTLILHLIHRMNSAAGFRKALATCSSHMIIV

                    290       300       310       320       330       340       350
             ....|....|....|....|....|....|....|....|....|....|....|....|....|....|
NOV12        LLLFCASFYTYMLPSSYHTAEQDMMVSAFYTIFTPVLNPLIYSLRNKDVTRALRSMMQSR--INEE---
gi|17437056| LLLFCASFYTYMLPSSYHTAEQDMMVSAFYTIFTPVLNPLIYSLRNKDVTRALRSMMQA---IESSNYSV
gi|17437027| LLLFCASFYTYMLRSSYHTAEQDMMVSAFYTIFTPVLNPLIYSLRNKDVTRALRSMMQSR--INEE---
gi|17437021| SLFYGAVVYTYMLPSSYHTPEKDMMVSVFYTILTPVLNPLIYSLRNKDVMGALKKMLTGFSHLPRQHQAV
gi|17437059| SLFYGAAIYTYMLPSSYHTPEKDMMVSVFYTILTPVLNPLIYSLRNKDVMGALKKMLT-----------
gi|15293809| LLLFCASFYTYMLPSSYHTAEQDMMVSAFYTIFTPV---------------------------------

                    360       370       380       390       400       410       420
             ....|....|....|....|....|....|....|....|....|....|....|....|....|....|
NOV12        ----------------------------------------------------------------------
gi|17437056| YADFILLGLFSNARFPWLLFALILLVFLTSIASNVVKIILIHIDSRLHTPMYFLLSQLSLRDILYISTIV
gi|17437027| ----------------------------------------------------------------------
gi|17437021| SVFCTVLTPMLNP---------LIYILRNKDVVGLFRKFWEHIKSLNRTHKYQCGKQR------------
gi|17437059| -----------------------------VEPAFQKAME-------------------------------
gi|15293809| ----------------------------------------------------------------------

                    430       440       450       460       470       480       490
             ....|....|....|....|....|....|....|....|....|....|....|....|....|....|
NOV12        ----------------------------------------------------------------------
gi|17437056| PKMLVDQVMSQRAISFAGCTAQHFLYLTLAGAEFFLLGLMSYDRYVAICNPLHYPVLMSRKICWLIVAAA
gi|17437027| ----------------------------------------------------------------------
gi|17437021| ----------------------------------------------------------------------
gi|17437059| ----------------------------------------------------------------------
gi|15293809| ----------------------------------------------------------------------

                    500       510       520       530       540       550       560
             ....|....|....|....|....|....|....|....|....|....|....|....|....|....|
NOV12        ----------------------------------------------------------------------
gi|17437056| WLGGSIDGFLLTPVTMQFPFCASREINHFFCEVPALLKLSCTDTSAYETAMYVCCIMMLLIPFSVISGSY
gi|17437027| ----------------------------------------------------------------------
gi|17437021| ----------------------------------------------------------------------
gi|17437059| ----------------------------------------------------------------------
gi|15293809| ----------------------------------------------------------------------

                    570       580       590       600       610       620       630
             ....|....|....|....|....|....|....|....|....|....|....|....|....|....|
NOV12        ----------------------------------------------------------------------
gi|17437056| TRILITVYRMSEAEGRGKAVATCSSHMVVVSLFYGAAMYTYVLPHSYHTPEQDKAVSAFYTILTPMLNPL
gi|17437027| ----------------------------------------------------------------------
gi|17437021| ----------------------------------------------------------------------
```

```
gi|17437059|   ----------------------------------------------------------------------
gi|15293809|   ----------------------------------------------------------------------

                       640       650       660       670       680       690       700
               ....|....|....|....|....|....|....|....|....|....|....|....|....|....|
NOV12          ----------------------------------------------------------------------
gi|17437056|   IYSLRNKDVTGALQKVVGRMEWKTLPFQALQVRCVKWRRSVLVSSFIATERTLADTSHSSSHAEFPERGV
gi|17437027|   ----------------------------------------------------------------------
gi|17437021|   ----------------------------------------------------------------------
gi|17437059|   ----------------------------------------------------------------------
gi|15293809|   ----------------------------------------------------------------------

                       710       720
               ....|....|....|....|....|
NOV12          -------------------------
gi|17437056|   RMNCSKLFSLVEEPVTSLGDLFNFR
gi|17437027|   -------------------------
gi|17437021|   -------------------------
gi|17437059|   -------------------------
gi|15293809|   -------------------------
```

Table 12E lists the domain description from DOMAIN analysis results against NOV12. This indicates that the NOV12 sequence has properties similar to those of other proteins known to contain these domains.

TABLE 12E

Domain Analysis of NOV12

```
gnl|Pfam|pfam00001, 7tm_1, 7 transmembrane receptor (rhodopsin
family). (SEQ ID NO:143)
Length = 254 residues, 99.6% aligned
Score = 107 bits (268), Expect = 8e-25

NOV12:   46 GNALLILLIHSEPRLHTPMYFFISQLALMDLMYLCVTVPKMLVGQVTGDDTISPSGCGIQ   105
            GN L+IL+I    +L TP  F+   LA+ DL++L    P  L   V GD     + C +
00001:    1 GNLLVILVILRTKKLRTPTNIFLLNLAVADLLFLLTLPPWALYYLVGGDWVFGDALCKLV    60

NOV12:  106 MFFYLTLAGAEVFLLAAMAYDRYAAVCRPLHYPLLMNQRVCQLLVSACWVLGMVDGLLLT   165
               ++    A + LL A++ DRY A+  PL Y  +   R  ++L+   WVL ++
00001:   61 GALFVVNGYASILLLTAISIDRYLAIVHPLRYRRIRTPRRAKVLILLVWVLALL-----   114

NOV12:  166 PITMSFPFCQSRKILSFFCETPALLKLSCSDVSLYKTLMYLCCILMLLAPTMVISSSYTL
               +S P      + +       +  +   + S+ ++ + L  ++  + P +VI   YT
00001:  115 ---LSLPPLLFSWLRTVEEGNTTVCLIDFPEESVKRSYVLLSTLVGFVLPLLVILVCYTR   171

NOV12:  226 ILHLIHR--------MNSAAGHRKALATCSSHMIIVLLLFG-----ASFYTYMLPSSYHT   272
            IL  + +           ++  RKA       +++ +L +          +  L S +
00001:  172 ILRTLRKRARSQRSLKRRSSSERKAAKMLLVVVVVFVLCWLPYHIVLLLDSLCLLSIWRV   231

NOV12:  273 AEQDMMVSAFYTIFTPVLNPLI                                        294
                ++++ +       LNP+I
00001:  232 LPTALLITLWLAYVNSCLNPII                                        253
```

G-Protein Coupled Receptors (GPCRs) have been identified as an extremely large family of protein receptors in a number of species. At the phylogenetic level they can be classified into four major subfamilies. These receptors share a seven transmembrane domain structure with many neurotransmitter and hormone receptors. They are likely to be involved in the recognition and transduction of various signals mediated by G-Proteins, hence their name G-Protein Coupled Receptors. The human GPCR genes are generally intron-less and belong to four gene subfamilies, displaying great sequence variability. These genes are dominantly expressed in olfactory epithelium.

Olfactory receptors (ORs) have been identified as an extremely large family of GPCRs in a number of species. As members of the GPCR family, these receptors share a seven transmembrane domain structure with many neurotransmitter and hormone receptors, and are likely to underlie the recognition and G-protein-mediated transduction of odorant signals. Like GPCRs, the ORs can be expressed in a variety of tissues where they are thought to be involved in recognition and transmission of a variety of signals. The human OR genes are typically intron-less and belong to four different gene subfamilies, displaying great sequence variability. These genes are dominantly expressed in olfactory epithelium.

The above defined information for NOV12 suggests that this NOV12 protein may function as a member of a Olfactory receptor/G-Protein Coupled Receptor protein family. Therefore, the NOV12 nucleic acids and proteins of the invention are useful in potential therapeutic and diagnostic applications. For example, a cDNA encoding the NOV12 protein may be useful in gene therapy, and the NOV12 protein may be useful when administered to a subject in need thereof. By way of nonlimiting example, the compositions of the present invention will have efficacy for treatment of patients suffering from developmental diseases, MHCII and III diseases (immune diseases), taste and scent detectability disorders, Burkitt's lymphoma, corticoneurogenic disease, signal transduction pathway disorders, retinal diseases including those involving photoreception, cell growth rate disorders, cell shape disorders, feeding disorders, potential obesity due to over-eating, potential disorders due to starvation (lack of appetite), noninsulin-dependent diabetes mellitus (NIDDM1), bacterial, fungal, protozoal and viral infections (particularly infections caused by HIV-1 or HIV-2), pain, cancer (including but not limited to neoplasm; adenocarcinoma; lymphoma; prostate cancer; uterus cancer), anorexia, bulimia, asthma, allergies, Parkinson's disease, acute heart failure, hypotension, hypertension, urinary retention, osteoporosis, Crohn's disease, multiple sclerosis, Albright hereditary ostoeodystrophy, angina pectoris, myocardial infarction, ulcers, benign prostatic hypertrophy, psychotic and neurological disorders (including anxiety, schizophrenia, manic depression, delirium, dementia, and severe mental retardation), dentatorubro-pallidoluysian atrophy (DRPLA), hypophosphatemic rickets, autosomal dominant (2) acrocallosal syndrome and dyskinesias, such as Huntington's disease and/or Gilles de la Tourette syndrome. The NOV12 nucleic acid encoding Olfactory receptor/G-Protein Coupled Receptor-like protein, and the Olfactory receptor/G-Protein Coupled Receptor-like protein of the invention, or fragments thereof, may further be useful in diagnostic applications, wherein the presence or amount of the nucleic acid or the protein are to be assessed.

NOV13

A disclosed NOV13 nucleic acid of 1606 nucleotides (designated CuraGen Acc. No. CG56097-01) encoding a novel glucuronosyltransferase-like protein is shown in Table 13A. An open reading frame was identified beginning with an ATG initiation codon at nucleotides 1–3 and ending with a TAG codon at nucleotides 1600–1602. A putative untranslated region downstream from the termination codon is underlined in Table 13A, and the start and stop codons are in bold letters.

TABLE 13A

NOV13 Nucleotide Sequence (SEQ ID NO:27)

ATGGCTATGAAATGGACTTCAGTCCTTCTGTTGATACAGCTGAGCTATTACTCTAGCTCTGGGAGTTGTGGAAATGTGC
CGCTGTGGCCCATGGAATATAGTCCTTGGATGAATATAAAGACAATCCTGGATAAACTTATGCAGATAAGTCATGAGGT
GACTGTTCTAACATTGTCAGCTTCCATTCTTGTTGATCCCAACATAACATCTGTTACTAAATTTGAGCGTTTATTCTATA
TCTGTAATTAAAGATGATTTTGCAGGGTTTTTTTTCACACAACAGATTACTAAATGGATACATGATCTTCCAAAACATA
TATTTTGGTTTAAATGTGTTCCCTTCAAGAATATTCTTTGGGAATATTCTGGTTATACTGAGAAGTTCTTTAAAGATGT
AGTTTTGAACAAGAAACTTATGACAAACCTACAAGAATCAAGGTCTGATGTCGTTCATGCAAATGCCATTGGTCCCTTT
GGAGAGCTGCTGGCTGAGCTATTAAAAATATCCTTTGTGTACAGTCTCCACTTCTCTCCTGGCTACACATTTGAGAAAT
ACAGTGGAGGATTTCTACTTCCACCTTCCTATGGAGCTGTTATTCTGTCAGAATTAAGTGGTTCGATGACATTCATGGA
GACAGTAAGAAATATTATATATGTGTTTTATTTTGACTTTTGGTTCCAAACATTTGATATGAAGAAGGGAGACCAGTTT
TACAGTGAAGTTCTAGGTAAGTCATGTTTTTTATCTGAGATAATGGGAAAAGCTGAAATGTGGCTCATTCGAAACTACT
GGTATTTGGAATTTCCTCGCCCACTCTTACCTAATTTTGAATTTGTTGTAAGACTCTACTGCAAACCTGTCACCCCCCT
GCCTAAGGAGAAAATGGAAGAATTTCCCCAGAGCTCTGATGAAGACGGTGTTGTGTTTTCTCTGGAGTCAGCTGTGCAA
AACCTTACAGAAGAAAAAGCTGATCTTATCACTTCGGCCCTGGCTCAGATTCCACAAAAAGTCATGAAGTTCGGAAGGA
AACCAAATACCTTAAGATCCAATACTCAGTGGCATAGGTGGATCCCACAGAATGAATGTCTTATCCTAGATCATCCCCA
AACCAAAGCCTTTATAACTTATGGTGGAACAAATAGCATCTATGAGATGATCTACCGTGGAGTCCCTTCCATGGGCATT
CCTTTGTTTGCGGACCAACATGATAACATTGCTCACATGAAGGCCAAGGGAGCAGCTGTTATATTGGACTTGAGCACAA
AGTCAAGTACAGATTTGCTCGATATATACTGTGTTCGTATCTTATTTTTATCCTTCAGATATAAAGAGAGTGTTATGAA
ATTATCAAGAATTCAACATGATCAACCAGTGAAGCCCCTGGATCGAGCAGTCTTCTGGATTGAATTTGTCATGCGCCAC
AAAGGAGCCAAACACCTTCGAGTTGCAGCCCGTGACCTCACCTGGTTCCAGTACCACTCTTTGGATGTGATTCGGTTTC
TGCTGGCCTGTGTGGCAACTGTGACATTTATCATCACAAAGTGTTGTCTGTTTTGTTTCTGGAAGTTTACTAGAAAAGT
GAAGAAGGAAAAAAGGGATTAGTTAT

The nucleic acid sequence of NOV13 maps to chromosome 4 and has 1305 of 1606 bases (81%) identical to a *Homo sapiens* 3,4-catechol estrogen UDP-glucuronosyltransferase mRNA (gb:GENBANK-ID:HUMUDPGTA|acc:J05428.1) (E=6.4e$^{-217}$).

A NOV13 polypeptide (SEQ ID NO:28) encoded by SEQ ID NO:27 is 533 amino acid residues and is presented using the one letter code in Table 13B. Signal P, Psort and/or Hydropathy results predict that NOV13 contains a signal peptide and is likely to be localized at the endoplasmic reticulum (membrane) with a certainty of 0.8200. The most likely cleavage site for a NOV13 peptide is between amino acids 20 and 21, at: SSS-GS.

TABLE 13B

NOV13 protein sequence (SEQ ID NO:28)

MAMKWTSVLLLIQLSYYSSSGSCGNVPLWPMEYSPWMNIKTILDKLMQISHEVTVLTLSASILVDPNITSVTKFEVYSISVIK
DDFAGFFFTQQITKWIHDLPKHIFWFKCVPFKNILWEYSGYTEKFFKDVVLNKKLMTNLQESRSDVVHANAIGPFGELLAELL
KISFVYSLHFSPGYTFEKYSGGFLLPPSYGAVILSELSGSMTFMETVRNIIYVFYFDFWFQTFDMKKGDQFYSEVLGKSCFLS
EIMGKAEMWLIRNYWYLEFPRPLLPNFEFVVRLYCKPVNPLPKEKMEEFAQSSDEDGVVFSLESAVQNLTEEKADLITSALAQ
IPQKVMKFGRKPNTLRSNTQWHRWIPQNECLILDHPQTKAPITYGGTNSIYEMIYRGVPSMGIPLFADQHDNLAHMKAKGAAV
ILDLSTKSSTDLLDISVFVSLFLSFRYKESVMKLSRIQHDQPVKPLDRAVFWIEFVMRHKGAKHLRVAARDLTWFQYHSLDVI
GFLLACVATVTFIITKCCLFCFWKFTRKVKKEKRD

The NOV13 amino acid sequence has 353 of 533 amino acid residues (66%) identical to, and 412 of 533 amino acid residues (77%) similar to, a Homo sapiens 529 amino acid residue UDP-glucuronosyltransferase 2b7 precursor, microsomal (EC 2.4.1.17) (UDPGT) (3,4-catechol estrogen specific) (ptnr:SWISSPROT-ACC:P16662) (E=$7.1e^{-185}$).

NOV13 is expressed in at least the following tissues: Liver. This information was derived by determining the tissue sources of the sequences that were included in the invention including but not limited to SeqCalling sources, Public EST sources, Literature sources, and/or RACE sources. In addition, NOV13 is predicted to be expressed in liver tissues because of the expression pattern of a closely related Homo sapiens 3,4-catechol estrogen UDP-glucuronosyltransferase mRNA homolog (gb:GENBANK-ID:HUMUDPGTA lacc:J05428.1).

NOV13 also has homology to the amino acid sequences shown in the BLASTP data listed in Table 13C.

TABLE 13C

BLAST results for NOV13

| Gene Index/ Identifier | Protein/Organism | Length (aa) | Identity (%) | Positives (%) | Expect |
|---|---|---|---|---|---|
| gi 4507825 ref\|NP_001065.1\| (NM_001074) | UDP glycosyltransferase 2 family, polypeptide B7; UDP-glucuronyltransferase, family 2, beta-7 [*Homo sapiens*] | 529 | 334/536 (62%) | 387/536 (71%) | e−179 |
| gi 6175083 sp\|P06133\|UDB4_HUMAN | UDP-GLUCURONOSYLTRANSFERASE 2B4 PRECURSOR, MICROSOMAL (UDPGT) (HYODEOXYCHOLIC ACID) (HLUG25) (UDPGTH-1) [*Homo sapiens*] | 528 | 333/536 (62%) | 386/536 (71%) | e−176 |
| gi 484383 pir\|JN0619 | glucuronosyltransferase (EC 2.4.1.17) 2B-4 precursor [*Homo sapiens*] | 528 | 332/536 (61%) | 385/536 (70%) | e−175 |
| gi 3153832 gb\|AAC95002.1\| (AF064200) | UDP-glucuronosyltransferase 2B4 precursor [*Homo sapiens*] | 528 | 332/536 (61%) | 386/536 (71%) | e−175 |
| gi 4079707 gb\|AAC98726.1\| (AF016310) | UDP-glucuronosyltransferase [*Macaca fascicularis*] | 529 | 330/536 (61%) | 385/536 (71%) | e−174 |

The homology of these sequences is shown graphically in the ClustalW analysis shown in Table 13D.

Table 13D ClustalW Analysis of NOV13

1) NOV13 (SEQ ID NO:28)
2) gi|4507825|ref|NP_001065.1| (NM_001074) UDP glycosyltransferase 2 family, polypeptide B7; UDP-glucuronyltransferase, family 2, beta-7 [Homo sapiens] (SEQ ID NO:144)
3) gi|6175083|sp|P06133|UDB4_HUMAN UDP-GLUCURONOSYLTRANSFERASE 2B4 PRECURSOR, MICROSOMAL (UDPGT) (HYODEOXYCHOLIC ACID) (HLUG25) (UDPGTH-1) [Homo sapiens] (SEQ ID NO:145)
4) gi|484383|pir||JN0619 glucuronosyltransferase (EC 2.4.1.17) 2B-4 precursor [Homo sapiens] (SEQ ID NO:146)
5) gi|3153832|gb|AAC95002.1| (AF064200) UDP-glucuronosyltransferase 2B4 precursor [Homo sapiens] (SEQ ID NO:147)
6) gi|4079707|gb|AAC98726.1| (AF016310) UDP-glucuronosyltransferase [Macaca fascicularis] (SEQ ID NO:148)

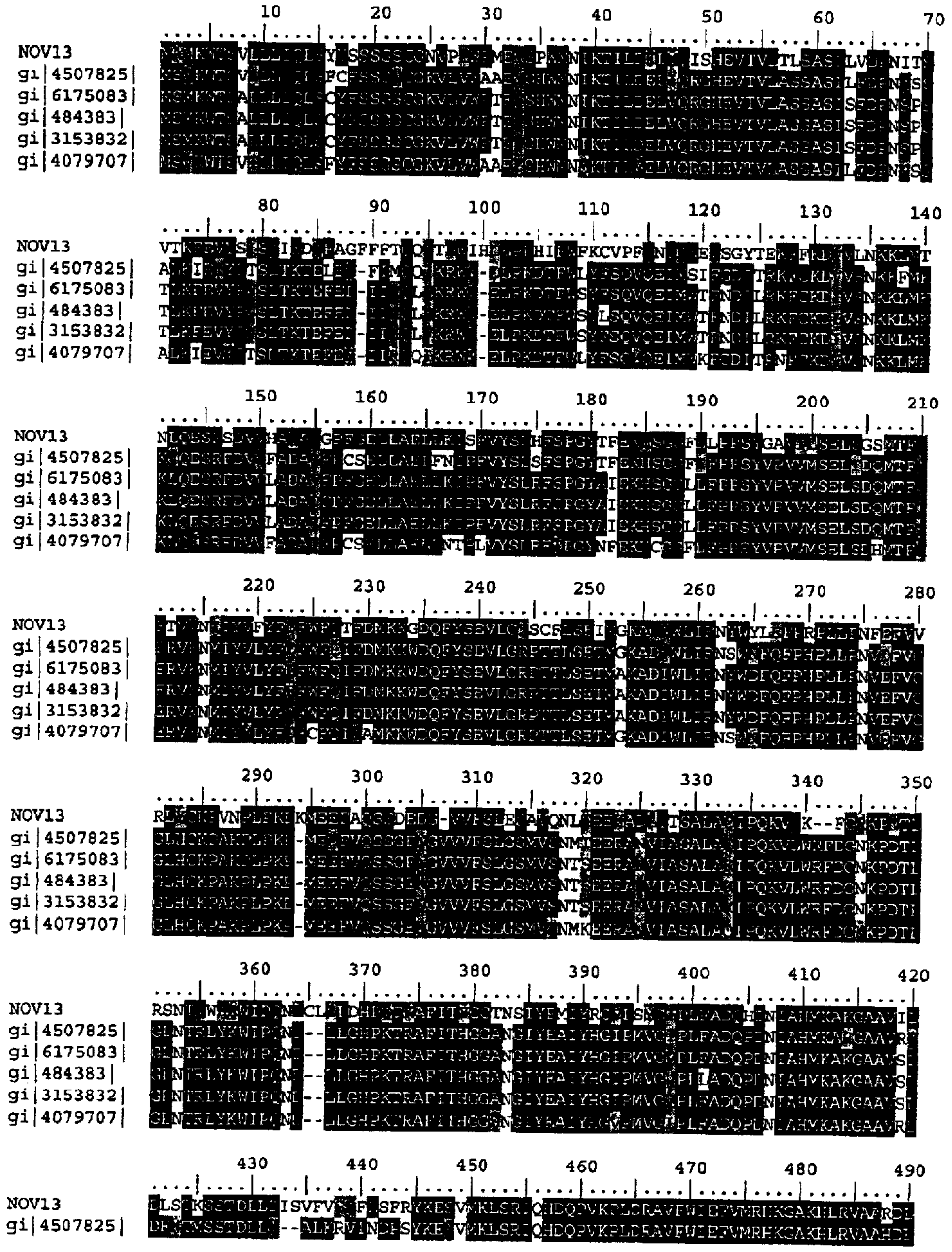

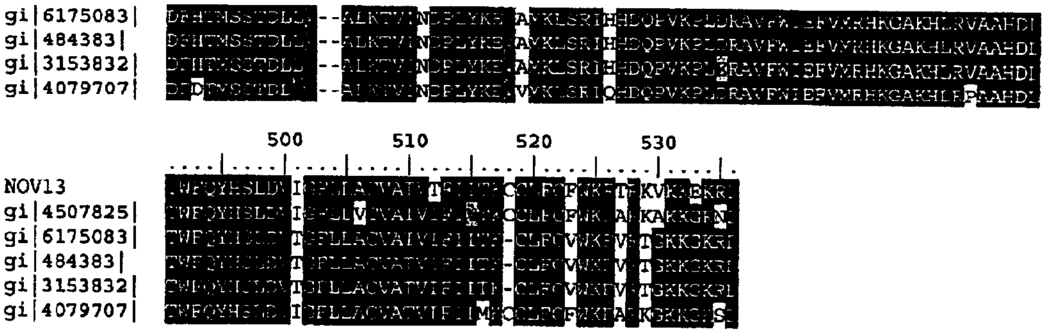
gi|6175083|
gi|484383|
gi|3153832|
gi|4079707|
500
510
520
530
NOV13
gi|4507825|
gi|6175083|
gi|484383|
gi|3153832|
gi|4079707|

```
gi|6175083|  DFHTMSSTDLL---ALKTVINDPLYKEAVKLSRIHHDQPVKPLDRAVFWIEFVVRHRGAKHLRVAAHDI
gi|484383|   DFHTMSSTDLL---ALKTVINDPLYKEAVKLSRIHHDQPVKPLDRAVFWIEFVVRHRGAKHLRVAAHDI
gi|3153832|  DFHTMSSTDLL---ALKTVINDPLYKEAVKLSRIHHDQPVKPLERAVFWIEFVVRHRGAKHLRVAAHDI
gi|4079707|  DFDTMSPTDLL---ALKTVINDPLYKEVVKLSRIQHDQPVKPLERAVFWIEFVVRHRGAKHLRPAAHDI

             500        510        520        530
             ....|....|....|....|....|....|....|....|.
NOV13        LWPQYHSLDVISPLAWVATRTRITRCMFRPFKETEKVKEKR
gi|4507825|  TWFQYHSLDIISLLVCVAIVLSIRSQCLFQFWKVAIKAKKGRNI
gi|6175083|  TWFQTHLDITSFLLACVAIVLSIITFICLFQVWKVVSIBKKCKRI
gi|484383|   TWFQTHLDITSFLLACVAIVLSIITFICLFQVWKFVTIBKKCKRI
gi|3153832|  TWLQAHLLDVTSILLACVAIVLFIITFICLFQVWKFVAIBKKCKRI
gi|4079707|  TWFQYHSLDIICFLLACVATVIFIIMPQLFRFKFASKGKCRLS
```

Table 13E lists the domain description from DOMAIN analysis results against NOV13. This indicates that the NOV13 sequence has properties similar to those of other proteins known to contain these domains.

TABLE 13E

Domain Analysis of NOV13

```
gnl|Pfam|pfam00201, UDPGT, UDP-glucoronosyl and UDP-glucosyl
transferase (SEQ ID NO:149)
Length = 501 residues, 100.0% aligned
Score = 587 bits (1514), Expect = 4e-169

NOV13:   24 GNVPLWPMEYSPWMNIKTILDKLMQISHEVTVLTLSASILVDPNITSVTKFEVYSISVIK   83
            G V +WPM+ S WMN+K IL +L+Q  HEVTVL  SASIL+ P   S  KFE Y  S  K
00201:    1 GKVLVWPMDGSHWMNMKGILLELVQRGHEVTVLRPSASILIGPAKPSNLKFETYPDSATK   60

NOV13:   84 DDFAGFFFTQQITKWIHDLPKHIFWFKCVPFKNILW-------EYSGYTEKFFKDVVLNK  136
            ++    F      K + +      WF        +W       EYS       K++V NK
00201:   61 EELENLF-----PKRVMN------WFMEAAEAGTVWSYFSALQEYSDGARVSCKELVGNK  109

NOV13:  137 KLMTNLQESRSDVVHANAIGPFGELLAELLKISFVYSLHFSPGYTFEKYSGGFLLPPSYG  196
             LMT LQES  DVV A+ + P G LLAELL I  VYSL F PGY  EK  GG   PPSY
00201:  110 FLMTKLQESSFDVVLADPVWPCGALLAELLHIPTVYSLRFVPGYAAEKADGGLPAPPSYV  169

NOV13:  197 AVILSELSGSMTFMETVRNIIYVFYFDFWFQTFDMKKGDQFYSEVLGKSCFLSEIMGKAE  256
             V LS+LS  MTF E V+N++ + YFDFWFQ F  KK DQF SE+LG+   L E + KA
00201:  170 PVRLSDLSDGMTFGERVKNMLIMLYFDFWFQRFP-KKWDQFASELLGRPVTLPEDLSKAS  228

NOV13:  257 MWLIRNYWYLEFPRPLLPNFEFVVRLYCKPVNPLPKEKMEEFAQSSDEDGVV-FSLESAV  315
             WL+RNYW LEFPRPLLPN EF+   L CKP  PLP+E ME F QSS E GVV FSL S V
00201:  229 AWLLRNYWDLEFPRPLLPNMEFIGGLNCKPAKPLPQE-MEAFVQSSGEHGVVVFSLGSMV  287

NOV13:  316 QNLTEEKADLITSALAQIPQKVM-KF-GRKPNTLRSNTQWHRWIPQNECLILDHPQTKAF  373
             N+ EEKA+ I SALAQIPQKV+ +F G KP+TL +NT+  +W+PQN+  +L HP+T+AF
00201:  288 SNIPEEKANEIASALAQIPQKVLWRFDGTKPSTLGNNTRLVKWLPQND--LLGHPKTRAF  345

NOV13:  374 ITYGGTNSIYEMIYRGVPSMGIPLFADQHDNIAHMKAKGAAVILDLSTKSSTDLLDISVF  433
            +T+ G+N+ YE I  GVP +G+PLF DQ DN  HM+AKGAAV L++ T +S DLL+
00201:  346 VTHAGSNGVYEAICHGVPMVGMPLFGDQMDNAKHMEAKGAAVTLNVLTMTSEDLLNALK-  404

NOV13:  434 VSLFLSFRYKESVMKLSRIQHDQPVKPLDRAVFWIEFVMRHKGAKHLRVAARDLTWFQYH  493
             ++     YKE++M+LS I HDQPVKPLDRAVFWIEFVMRHKGAKHLR AA DLTW+QYH
00201:  405 -TVINDPSYKENIMRLSSIHHDQPVKPLDRAVFWIEFVMRHKGAKHLRPAAHDLTWYQYH  463

NOV13:  494 SLDVIGFLLACVATVIFIITKCCLFCFWKFTRKVKKEK                        531
            SLDVIGFLLACVATV FI  KCCLF + KF  K K+ K
00201:  464 SLDVIGFLLACVATVAFITFKCCLFGYRKFVGKKKRVK                        501
```

The UDP-glucuronosyltransferases, a group of isoenzymes located primarily in hepatic endoplasmic reticulum and nuclear envelope, are encoded by a large multigene family that has evolved to produce catalysts with differing but overlapping substrate specificities. Two subfamilies are recognized by sequence identities (Burchell et al., 1991). UGT1 consists of at least 4 isoenzymes that catalyze the glucuronidation of phenols and bilirubin. All 4 map to chromosome 2 and probably derive from the same gene (UGT1). The UGT2 family contains at least 5 members catalyzing steroid or bile acid glucuronidation. Members of the subfamily share 65 to 90% amino acid sequence identity. However, unlike the phenol UGT cDNAs, where the high degree of identity is concentrated in the 3-prime region of the cDNA, the steroid UGTs have a high degree of sequence homology throughout the cDNA. Jackson et al. (1987) cloned a human liver microsomal UDP-glucuronosyltransferase cDNA. By screening a liver library with a rat UGT2B 1 cDNA, Jin et al. (1993) isolated cDNAs encoding UGT2B4, which they called UGT2B11, and UGT2B10. The deduced amino acid sequences shared greater than 76% sequence similarity with other known human liver UGT2B subfamily isoforms. The predicted 528-amino acid UGT2B4 protein contained an N-terminal signal peptide and a C-terminal transmembrane hydrophobic region. Mammalian cells expressing UGT2B4 produced a 51-kD protein that was recognized by a UGT-specific polyclonal antibody. The expressed protein catalyzed the glucuronidation of several polyhydroxylated estrogens and xenobiotics. Monaghan et al. (1992) stated that the 5 members of subfamily 2 are probably derived from independent genes. Due to the difficulty in isolating suitable specific cDNA probes from the UGT2 members, Monaghan et al. (1992) used the polymerase chain reaction (PCR) in the chromosomal mapping of the steroid UGT gene encoding a bile acid UGT. Analysis of a panel of human/rodent somatic cell hybrids indicated that the gene, symbolized UGT2B, is located on human chromosome 4. Burchell et al. (1991) recommended that the symbol Udpgt-3 used by Krasnewich et al. (1987) be changed to Ugt2b. Monaghan et al. (1992) used PCR to map the UGT2B4 gene to chromosome 4. The corresponding gene in the mouse was assigned to chromosome 5, which has a region of homology with human chromosome 4, by Krasnewich et al. (1987). By fluorescence in situ hybridization with a YAC containing all 3 genes, Monaghan et al. (1994) localized UGT2B4, UGT2B9 (also called UGT2B7), and UGT2B 15 to 4q13. They provisionally ordered the genes as UGT2B9-UGT2B4-UGT2B 15. Riedy et al. examined a genomic map spanning approximately 500 to 1000 kb in the 4q13 region. They placed UGT2B4 between UGT2B7 and UGT2B15. Also, access to a large reference DNA bank allowed them to calculate the allele frequencies for a single nucleotide polymorphism (SNP), Q458D, in UGT2B4 among 803 unrelated individuals representing 5 ethnic populations. The findings suggested a recent evolutionary history of gene duplication, mutation, and rearrangement.

The above defined information for NOV13 suggests that this NOV13 protein may function as a member of a glucuronosyltransferase protein family. Therefore, the NOV13 nucleic acids and proteins of the invention are useful in potential therapeutic and diagnostic applications. For example, a cDNA encoding the NOV13 protein may be useful in gene therapy, and the NOV13 protein may be useful when administered to a subject in need thereof. By way of nonlimiting example, the compositions of the present invention will have efficacy for treatment of patients suffering from Crigler-Najjar syndrome and/or Gilbert syndrome. The NOV13 nucleic acid encoding glucuronosyltransferase-like protein, and the glucuronosyltransferase-like protein of the invention, or fragments thereof, may further be useful in diagnostic applications, wherein the presence or amount of the nucleic acid or the protein are to be assessed.

NOV14

NOV14 includes two novel prostasin-like proteins disclosed below and two nucleic acid assembly sequences. The disclosed proteins have been named NOV14a and NOV14b.

NOV14a

A disclosed NOV14a nucleic acid of 1726 nucleotides (designated CuraGen Acc. No. CG56123-01) encoding a novel prostasin-like protein is shown in Table 14A. An open reading frame was identified beginning with an ATG initiation codon at nucleotides 229–231 and ending with a TGA codon at nucleotides 1150–1152. A putative untranslated region downstream from the termination codon is underlined in Table 14A, and the start and stop codons are in bold letters.

TABLE 14A

| NOV14a Nucleotide Sequence |
| --- |
| (SEQ ID NO:29) |
| AGACGGTGCTGGTGACTCGTCCACACTGCTCGCTTCGGATACTCCAGGCGTCTCCCGTTGCGGCCGCTCCCTGCCTTAG |
| AGGCCAGCCTTGGACACTTGCTGCCCCTTTCCAGCCCGGATTCTGGGATCCTTCCCTCTGAGCCAACATCTGGGTCCTG |
| CCTTCGACACCACCCCAAGGCTTCCTACCTTGCGTGCCTGGAGTCTGCCCCAGGGGCCCTTGTCCTGGCC**ATG**GCCCAG |
| AAGGGGGTCCTGGGGCCTGGGCAGCTGGGGGCTGTGGCCATTCTGCTCTATCTTGGATTACTCCGGTCGGGGACAGGAG |
| CGGAAGGGGCAGAAGCTCCCTGCGGTGTGGCCCCCCAAGCACGCATCACAGGTGGCAGCAGTGCAGTCGCCGGTCAGTG |
| GCCCTGGCAGGTCAGCATCACCTATGAAGGCGTCCATGTGTGTGGTGGCTCTCTCGTGTCTGAGCAGTGGGTGCTGTCA |
| GCTGCTCACTGCTTCCCCAGCGAGCACCACAAGGGCTCCCAGGGCGACATTGCACTCCTCCAACTCAGCAGACCCACCA |
| GCTACTCCCGCTACATCCGGCCCATCTGCCTCCCTGCAGCCAACGCCTCCTTCCCCAACGGCCTCCACTGCACTGTCAC |
| TGGCTGGGGTCATGTGGCCCCCTCAGTGAGCCTCCTGACGCCCAAGCCACTGCAGCAACTCGAGGTGCCTCTGATCAGT |
| CGTGAGACGTGTAACTGCCTGTACAACATCGACGCCAAGCCTGAGGAGCCGCACTTTGTCCAAGAGGACATGGTGTGTG |
| CTGGCTATGTGGAGGGGGGCAAGGACGCCTGCCAGGGTGACTCTGGGGACCCACTCTCCTGCCCTGTGGAGGGTCTCTG |
| GTACCTGACGGGCATTGTGAGCTGGGGAGATGCCTGTGGGGCCCGCAACAGGCCTGGTGTGTACACTCTGGCCTCCAGC |
| TATGCCTCCTGGATCCAAAGCAAGGTGACAGAACTCCAGCCTCGTGTGGTGCCCCAAACCCAGGAGTCCCAGCCCGACA |
| GCAACCTCTGTGGCAGCCACCTGGCCTTCAGCTCTGCCCCAGCCCAGGGCTTGCTGAGGCCCATCCTTTTCCTGCCTCT |
| GGGCCTGGCTCTGGGCCTCCTCTCCCCATGGCTCAGCGAGCAC**TGA**GCTGGCCCTACTTCCAGGATGGATGCATCACAC |
| TCAAGGACAGGAGCCTGGTCCTTCCCTGATGGCCTTTGGACCCAGGGCCTGACTTGAGCCACTCCTTCCTTCAGGACTC |
| TGCGGGAGGCTGGGGCCCCATCTTGATCTTTGAGCCCATTCTTCTGGGTGTGCTTTTTGGGACCATCACTGAGAGTCAG |
| GAGTTTTACTGCCTGTAGCAATGGCCAGAGCCTCTGGCCCCTCACCCACCATGGACCAGCCCATTGGCCGAGCTCCTGG |
| GGAGCTCCTGGGACCCTTGGCTATGAAAATGAGCCCTGGCTCCCACCTGTTTCTGGAAGACTGCTCCCGGCCCGCCTGC |
| CCAGACTGATGAGCACATCTCTCTGCCCTCTCCCTGTGTTCTGGGCTGGGGCCACCTTTGTGCAGCTTCGAGGACAGGA |
| AAGGCCCCAATCTTGCCCACTGGCCGCTGAGCGCCCCCGAGCCCTGACTCCTGGACTCCGGAGGACTGAGCCCCCACGG |
| GAACTGGGCTGGCGCTTGGATCTGGGGTGGGAGTAACAGGGCAGAAATGATTAAAATGTTTGAGCAC |

The nucleic acid sequence of NOV14a maps to chromosome 16p11.2 and has 1229 of 1238 bases (99%) identical to a *Homo sapiens* prostasin mRNA (gb:GENBANK-ID:HUMPROS\|acc:L41351.1) (E=$3.3e^{-270}$).

A NOV14a polypeptide (SEQ ID NO:30) encoded by SEQ ID NO:29 is 307 amino acid residues and is presented using the one letter code in Table 14B. Signal P, Psort and/or Hydropathy results predict that NOV14a contains a signal peptide and is likely to be localized at the plasma membrane with a certainty of 0.8812. The most likely cleavage site for a NOV14a peptide is between amino acids 29 and 30, at: GTG-AE.

TABLE 14B

| NOV14a protein sequence |
|---|
| (SEQ ID NO:30)<br>MAQKGVLGPGQLGAVAILLYLGLLRSGTGAEGAEAPCGVAPQARITGGSSAVAGQWPWQVSITYEGVHVCGGSLVSEQWVLSA<br>AHCFPSEHHKGSQGDIALLQLSRPTSYSRYIRPICLPAANASFPNGLHCTVTGWGHVAPSVSLLTPKPLQQLEVPLISRETCN<br>CLYNIDAKPEEPHFVQEDMVCAGYVEGGKDACQGDSGDPLSCPVEGLWYLTGIVSWGDACGARNRPGVYTLASSYASWIQSKV<br>TELQPRVVPQTQESQPDSNLCGSHLAFSSAPAQGLLRPILFLPLGLALGLLSPWLSEH |

The NOV14a amino acid sequence has 212 of 220 amino acid residues (96%) identical to, and 215 of 220 amino acid residues (97%) similar to, a *Homo sapiens* 343 amino acid residue prostasin precursor (EC 3.4.21.-) (ptnr:SWISSPROT-ACC:Q16651) ($E=6.2e^{-166}$). Additional to the 4 amino acids mismatch, the NOV14a sequence lacks 36 internal amino acids, when compared to the *Homo sapiens* prostasin precursor (EC 3.4.21.-) (ptnr:SWISSPROT-ACC:Q16651).

NOV14a is expressed in at least the following tissues: Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, Ascending Colon, Bronchus, Colon, Duodenum, Gall Bladder, Kidney Cortex, Liver, Lung, Lung Pleura, Ovary, Parathyroid Gland, Parotid Salivary glands, Peripheral Blood, Respiratory Bronchiole, Thymus, and Whole Organism. This information was derived by determining the tissue sources of the sequences that were included in the invention including but not limited to SeqCalling sources, Public EST sources, Literature sources, and/or RACE sources. In addition, NOV14a is predicted to be expressed in seminal fluid because of the expression pattern of a closely related *Homo sapiens* prostasin mRNA homolog (gb:GENBANK-ID:HUMPROS|acc:L41351.1).

NOV14b

A disclosed NOV14b nucleic acid of 1161 nucleotides (designated CuraGen Acc. No. CG56123-02) encoding a novel prostasin precursor-like protein is shown in Table 14C. An open reading frame was identified beginning with an ATG initiation codon at nucleotides 1–3 and ending with a TGA codon at nucleotides 1159–1161. The start and stop codons are in bold letters in Table 14C.

TABLE 14C

| NOV14b Nucleotide Sequence |
|---|
| (SEQ ID NO:31)<br>**ATG**GCCCAGAAGGGGGTCCTGGGGCCTGGGCAGCTGGGGGCTGTGGCCATTCTGCTCTATCTTGGATTACTCCGGTCGG<br>GGACAGGAGCGGAAGGGGCAGAAGGGAATGCCCAGATTGGTGTGGTGGAAACAGACACAGTTGTGGACTCCGGAACATT<br>TGTGAGACTGGGCAGCATCGGGGAGCATGGTGGAGGTTGGGGGGTGCTGGGCTCGGAGGCAATGCCCAACTCAGCCAGC<br>AGAAGCCCGCCTGTCTACGGAGGGGCTGCTGTTCCAATCAAGCATCCACAGGCAAAGGGAAGTTTGCCAGACACTCCCT<br>GCGGTGTGGCCCCCCAAGCACGCATCACAGGTGGCAGCAGTGCAGTCGCCGGTCAGTGGCCCTGGCAGGTCAGCATCAC<br>CTATGAAGGCGTCCATGTGTGTGGTGGCTCTCTCGTGTCTGAGCAGTGGGTGCTGTCAGCTGCTCACTGCTTCCCCAGC<br>GAGCACCACAAGGAAGCCTATGAGGTCAAGCTGGGGGCCCACCAGCTAGACTCCTACTCCGAGGACGCCAAGGTCAGCA<br>CCCTGAAGGACATCATCCCCCACCCCAGCTACCTCCAGGAGGGCTCCCAGGGCGACATTGCACTCCTCCAACTCAGCAG<br>ACCCATCACCTTCTCCCGCTACATCCGGCCCATCTGCCTCCCTGCAGCCAACGCCTCCTTCCCCAACGGCCTCCACTGC<br>ACTGTCACTGGCTGGGGTCATGTGGCCCCCTCAGTGAGCCTCCTGACGCCCAAGCCACTGCAGCAACTCGAGGTGCCTC<br>TGATCAGTCGTGAGACGTGTAACTGCCTGTACAACATCGACGCCAAGCCTGAGGAGCCGCACTTTGTCCAAGAGGACAT<br>GGTGTGTGCTGGCTATGTGGAGGGGGGCAAGAACGCCTGCCAGGGTGACTCTGGGGGCCCACTCTCCTGCCCTGTGGAG<br>GGTCTCTGGTACCTGACGGGCATTGTGAGCTGGGGAGATGCCTGTGGGGCCCGCAACAGGCCTGGTGTGTACACTCTGG<br>CCTCCAGCTATGCCTCCTGGATCCAAAGCAAGGACTCTGCGGGAGGCTGGGGCCCCATCTTGATCTTTGAGCCCATTCT<br>TCTGGGTGTGCTTTTTGGGACCATCACTGAGAGTCAGGAGTTTTACTGCCTG**TAG** |

The nucleic acid sequence of NOV 14b maps to chromosome 16 and has 766 of 776 bases (98%) identical to a *Homo sapiens* prostasin mRNA (gb:GENBANK-ID:HUMPROS|acc:L41351.1) (E=5.5e$^{-207}$).

A NOV14b polypeptide (SEQ ID NO:32) encoded by SEQ ID NO:31 is 386 amino acid residues and is presented using the one letter code in Table 14D. Signal P, Psort and/or Hydropathy results predict that NOV14b contains a signal peptide and is likely to be localized at the plasma membrane with a certainty of 0.8434. The most likely cleavage site for a NOV14b peptide is between amino acids 29 and 30, at: GTG-AE.

TABLE 14D

| NOV14b protein sequence |
|---|
| (SEQ ID NO:32) |
| MAQKGVLGPGQLGAVAILLYLGLLRSGTGAEGAEGNAQIGVVETDTVVDSGTIVRLGSIGEHGGGWGVLGSEAMPNSASRSPP |
| VYGGAAVPIKHPQAKGSLPDTPCGVAPQARITGGSSAVAGQWPWQVSITYEGVHVCGGSLVSEQWVLSAAHCFPSEHHKEAYE |
| VKLGAHQLDSYSEDAKVSTLKDIIPHPSYLQEGSQGDIALLQLSRPITFSRYIRPICLPAANASFPNGLHCTVTGWGHVAPSV |
| SLLTPKPLQQLEVPLISRETCNCLYNIDAKPEEPHFVQEDMVCAGYVEGGKDACQGDSGGPLSCPVEGLWYLTGIVSWGDACG |
| ARNRPGVYTLASSYASWIQSKDSAGGWGPILIFEPILLGVLFGTITESQEFYCL |

The NOV14b amino acid sequence has 251 of 257 amino acid residues (97%) identical to, and 254 of 257 amino acid residues (98%) similar to, a *Homo sapiens* 343 amino acid residue prostasin precursor (EC 3.4.21.-) (ptnr:SWISSPROT-ACC:Q16651) (E=1.3e$^{-154}$).

NOV14b is expressed in at least the following tissues: prostate, liver, salivary gland, kidney, lung, pancreas, colon, bronchus, renal proximal tubular cells and prostate carcinoma LNCaP cells. This information was derived by determining the tissue sources of the sequences that were included in the invention including but not limited to SeqCalling sources, Public EST sources, Literature sources, and/or RACE sources and the expression pattern of a closely related *Homo sapiens* prostasin mRNA homolog (gb:GENBANK-ID:HUMPROS|acc:L41351.1).

NOV14 Assemblies

An insert assembly 162262711, Table 14E, was found to encode an open reading frame between residues 30 and 283 of the target sequence of NOV14a (CG56123-01). The cloned insert differs from the original sequence by 36-amino acid insertion between amino acids 93 and 94 of NOV14a, and a replacement of the amino acids TSY by ITL at positions 108–110. An insert assembly 162262716, Table 14F, differs from the insert assembly 162262711 by one amino acid (ITF instead of ITL at positions 108–110 of NOV14a).

TABLE 14E

| 162662711 Nucleotide Sequence | |
|---|---|
| AGATCTGCGGAAGGGGCAGAAGCTCCCTGCGGTGTGGCCCCCCAAGCACGCATCACAGGTGGC | (SEQ ID NO:33) |
| AGCAGTGCAGTCGCCGGTCAGTGGCCCTGGCAGGTCAGCATCACCTATGAAGGCGTCCATGTG | |
| TGTGGTGGCTCTCTCGTGTCTGAGCAGTGGGTGCTGTCAGCTGCTCACTGCTTCCCCAGCGAG | |
| CACCACAAGGAAGCCTATGAGGTCAAGCTGGGGGCCCACCAGCTAGACTCCTACTCCGAGGAC | |
| GCCAAGGTCAGCACCCTGAACGACATCATCCCCCACCCCAGCTACCTCCAGGAGGGCTCCCAG | |
| GGCGACATTGCACTCCTCCAACTCAGCAGACCCATCACCCTCTCCCGCTACATCCGGCCCATC | |
| TGCCTCCCTGCAGCCAACGCCTCCTTCCCCAACGGCCTCCACTGCACTGTCACTGGCTGGGGT | |
| CATGTGGCCCCCTCAGTGAGCCTCCTGACGCCCAAGCCACTGCAGCAACTCGAGGTGCCTCTG | |
| ATCAGTCGTGAGACGTGTAACTGCCTGTACAACATCGACGCCAAGCCTGAGGAGCCGCACTTT | |
| GTCCAAGAGGACATGGTGTGTGCTGGCTATGTGGAGGGGGGCAAGGACGCCTGCCAGGGTGAC | |
| TCTGGGGGCCCACTCTCCTGCCCTGTGGAGGGTCTCTGGTACCTGACGGGCATTGTGAGCTGG | |
| GGAGATGCCTGTGGGGCCCGCAACAGGCCTGGTCTGTACACTCTGGCCTCCAGCTATGCCTCC | |
| TGGATCCAAAGCAAGGTGACAGAACTCCAGCCTCGTGTGGTGCCCCAAACCCAGGAGTCCCAG | |
| CCCGACAGCAACCTCTGTGGCAGCCACCTGGCCTTCAGCTCTGCCCCAGCCCAGGGCGTCGAC | |

TABLE 14F

| 162662716 Nucleotide Sequence | |
|---|---|
| AGATCTGCGGAAGGGGCAGAAGCTCCCTGCGGTGTGGCCCCCCAAGCACGCATCACAGGTGGC | (SEQ ID NO:34) |
| AGCAGTGCAGTCGCCGGTCAGTGGCCCTGGCAGGTCAGCATCACCTATGAAGGCGTCCATGTG | |
| TGTGGTGGCTCTCTCGTGTCTGAGCAGTGGGTGCTGTCAGCTGCTCACTGCTTCCCCAGCGAG | |
| CACCACAAGGAAGCCTATGAGGTCAAGCTGGGGGCCCACCAGCTAGACTCCTACTCCGAGGAC | |
| GCCAAGGTCAGCACCCTGAAGGACATCATCCCCCACCCCAGCTACCTCCAGGAGGGCTCCCAG | |
| GGCGACATTGCACTCCTCCAACTCAGCAGACCCATCACCTTCTCCCGCTACATCCGGCCCATC | |
| TGCCTCCCTGCAGCCAACGCCTCCTTCCCCAACGGCCTCCACTGCACTGTCACTGGCTGGGGT | |
| CATGTGGCCCCCTCAGTGAGCCTCCTGACGCCCAAGCCACTGCAGCAACTCGAGGTGCCTCTG | |
| ATCAGTCGTGAGACGTGTAACTGCCTGTACAACATCGACGCCAAGCCTGAGGAGCCGCACTTT | |
| GTCCAAGAGGACATGGTGTGTGCTGGCTATGTGGAGCGGGGCAAGGACGCCTGCCAGGGTGAC | |
| TCTGGGGGCCCACTCTCCTGCCCTGTGGAGGGTCTCTGGTACCTGACGGGCATTGTGAGCTGG | |
| GGAGATGCCTGTGGGGCCCGCAACAGGCCTGGTGTGTACACTCTGGCCTCCAGCTATGCCTCC | |
| TGGATCCAAAGCAAGGTGACAGAACTCCAGCCTCGTGTGGTGCCCCAAACCCAGGAGTCCCAG | |
| CCCGACAGCAACCTCTGTCGCAGCCACCTGGCCTTCAGCTCTGCCCCAGCCCAGGGCGTCGAC | |

Possible small nucleotide polymorphisms (SNPs) found for NOV14a are listed in Tables 14G and 14H.

TABLE 14G

| SNPs | | | |
|---|---|---|---|
| Consensus Position | Depth | Base Change | PAF |
| 188 | 9 | G > T | 0.222 |
| 190 | 9 | G > C | 0.222 |
| 196 | 9 | C > G | 0.222 |
| 197 | 9 | A > G | 0.222 |
| 203 | 9 | -> C | 0.222 |
| 212 | 9 | -> C | 0.222 |
| 212 | 9 | -> T | 0.222 |
| 291 | 10 | -> C | 0.300 |
| 292 | 10 | -> C | 0.300 |
| 332 | 10 | T > C | 0.200 |
| 555 | 8 | G > A | 0.250 |

TABLE 14H

| SNPs | | | | |
|---|---|---|---|---|
| Variant | Nucleotide Position | Base Change | Amino Acid Position | Base Change |
| 13376700 | 373 | A > G | 49 | Ser > Gly |
| 13376699 | 447 | T > C | Silent | N/A |
| 13374234 | 617 | T > C | 130 | Leu > Pro |
| 13376698 | 690 | A > G | Silent | N/A |
| 13374602 | 698 | T > C | 157 | Val > Ala |
| 13374601 | 737 | A > C | 170 | Asn > Thr |
| 13374235 | 839 | A > G | 204 | Asp > Gly |
| 13374600 | 1090 | A > G | 288 | Ile > Val |

NOV14a and NOV14b are very closely homologous as is shown in the amino acid alignment in Table 14I.

Table 14I Amino Acid Alignment of NOV14a and NOV14b

```
                10        20        30        40        50        60        70
        ....|....|....|....|....|....|....|....|....|....|....|....|....|....|
NOV14a  MAQKGVLGPGQLGAVAILLYLGLLRSGTCAEGAEA-----------------------------------
NOV14b  MAQKGVLGPGQLGAVAILLYLGLLRSGTCAEGAEGNAQIGVVETDTVVDSGTIVRLGSIGEHGGGWGVLG

                80        90       100       110       120       130       140
        ....|....|....|....|....|....|....|....|....|....|....|....|....|....|
NOV14a  ----------------------------------PCGVAPQARITGGSSAVAGQWPWQVSITYEGVHVCG
NOV14b  SEAMPNSASRSPPVYGGAAVPIKHPQAKGSLPDTPCGVAPQARITGGSSAVAGQWPWQVSITYEGVHVCG

               150       160       170       180       190       200       210
        ....|....|....|....|....|....|....|....|....|....|....|....|....|....|
NOV14a  GSLVSEQWVLSAAHCFPSEHHK------------------------------------GSQGDIALLQLS
NOV14b  GSLVSEQWVLSAAHCFPSEHHKEAYEVKLGAHQLDSYSEDAKVSTLKDIIPHPSYLQEGSQGDIALLQLS

               220       230       240       250       260       270       280
        ....|....|....|....|....|....|....|....|....|....|....|....|....|....|
NOV14a  RIT[illegible]SRYIRPICLPAANASFPNGLHCTVTGWGHVAPSVSLLTPKPLQQLEVPLISRETCNCLYNIDAKP
NOV14b  RPI[illegible]SRYIRPICLPAVNASPINCLHCTVTGWGHVAPSVSLLTPKPLQQLEVPLISRETCNCLYNIDAKP

               290       300       310       320       330       340       350
        ....|....|....|....|....|....|....|....|....|....|....|....|....|....|
NOV14a  EEPHFVQEDMVCAGYVEGGKDACQGDSGCPLSCPVEGLWYLTGIVSWGDACGARNRPGVYTLASSYASWI
NOV14b  EEPHFVQEDMVCAGYVEGGKDACQGDSGGPLSCPVEGLWYLTGIVSWGDACGARNRPGVYTLASSYASWI

               360       370       380       390       400       410
```

```
         ....|....|....|....|....|....|....|....|....|....|....|....|..
NOV14a   QS[illegible]VTELQPRVVPQTQESQPDSNLC[illegible]SHLA[illegible]SSAPAQG[illegible]RP[illegible]L[illegible]LP[illegible]GL[illegible]LGLLSPWLSEH
NOV14b   QS[illegible]--------------DSAGG--W[illegible]PILI[illegible]EP-----[illegible]LG[illegible]L[illegible]GT[illegible]TE[illegible]QEFYCL-----
```

Homologies to any of the above NOV14 proteins will be shared by the other NOV14 proteins insofar as they are homologous to each other as shown above. Any reference to NOV14 is assumed to refer to both of the NOV14 proteins in general, unless otherwise noted.

NOV14a also has homology to the amino acid sequences shown in the BLASTP data listed in Table 14J.

TABLE 14J

BLAST results for NOV14a

| Gene Index/ Identifier | Protein/Organism | Length (aa) | Identity (%) | Positives (%) | Expect |
|---|---|---|---|---|---|
| gi\|4506153\|ref\|NP_002764.1\| (NM_002773) | protease, serine, 8 (prostasin) [*Homo sapiens*] | 343 | 278/318 (87%) | 280/318 (87%) | e−148 |
| gi\|11181573\|gb\|AAG32641.1\|AF202076_1 (AF202076) | prostasin [*Rattus norvegicus*] | 342 | 217/318 (68%) | 240/318 (75%) | e−113 |
| gi\|13632973\|sp\|Q9ES87\|PSS8_RAT | Prostasin precursor [*Rattus norvegicus*] | 342 | 217/318 (68%) | 239/318 (74%) | e−112 |
| gi\|13277969\|gb\|AAH03851.1\|AAH03851 (BC003851) | Similar to protease, serine, 8 (prostasin) [*Mus musculus*] | 339 | 218/317 (68%) | 240/317 (74%) | e−112 |
| gi\|13633203\|sp\|Q9ESD1\|PSS8_MOUSE | Prostasin precursor (Channel activating protease 1) [*Mus musculus*] | 342 | 217/317 (68%) | 239/317 (74%) | e−111 |

The homology of these sequences is shown graphically in the ClustalW analysis shown in Table 14K.

Table 14K ClustalW Analysis of NOVK

1) NOV14a (SEQ ID NO:30)
2) gi|4506153|ref|NP_002764.1| (NM_002773) protease, serine, 8 (prostasin) [Homo sapiens] (SEQ ID NO:150)
3) gi|11181573|gb|AAG32641.1|AF202076_1 (AF202076) prostasin [Rattus norvegicus] (SEQ ID NO:151)
4) gi|13632973|sp|Q9ES87|PSS8_RAT Prostasin precursor [Rattus norvegicus] (SEQ ID NO:152)
5) gi|13277969|gb|AAH03851.1|AAH03851 (BC003851) Similar to protease, serine, 8 (prostasin) [Mus musculus] (SEQ ID NO:153)
6) gi|13633203|sp|Q9ESD1|PSS8_MOUSE Prostasin precursor (Channel activating protease 1) [Mus musculus] (SEQ ID NO:154)

```
                        10        20        30        40        50        60        70
                ....|....|....|....|....|....|....|....|....|....|....|....|....|....|
NOV14a          MAQKGVLGPGQLGAVAILLYLGLLRSGTGAEGAEAPCGVAPQARITGGSSAVAGQWPWQVSITYEGVHVC
gi|4506153|     MAQKGVLGPGQLGAVAILLYLGLLRSGTGAEGAEAPCGVAPQARITGGSSAVAGQWPWQVSITYEGVHVC
gi|11181573|    MALRVGLGLGQLEAAFILLLGLLQSRIGADGTEASCGAVIQPRITGGGSAKPGQWPWQVSITYNGVHVC
gi|13632973|    MALRVGLGLGQLEAAFILLLGLLQSRIGADGTEASCGAVIQPRITGGGSAKPGQWPWQVSITYNGVHVC
gi|13277969|    MALRVGLGLGQLEAVTILLLLGHLQSGIRADGTEASCGAVIQPRITGGGSAKPGQWPWQVSITYDGNHVC
gi|13633203|    MAPRVGLGLGQLEAVTILLLLGHLQSGIRADGTEASCGAVIQPRITGGGSAKPGQWPWQVSITYDGNHVC

                        80        90       100       110       120       130       140
                ....|....|....|....|....|....|....|....|....|....|....|....|....|....|
NOV14a          GGSLVSEQWVLSAAHCFPSEHHK------------------------------------GSQGDLALLQL
```

```
gi|4506153|   GGSLVSEQWVLSAAHCFPSEHHKEAYEVKLGAHQLDSYSEDAKVSTLKDIIPHPSYLQEGSQGDIALLQL
gi|11181573|  GGSLVSNQWVVSAAHCFPREHSKEEYEVKLGAHQLDSFSNDIVVHTVAQIISHSSYREEGSQGDIALIRL
gi|13632973|  GGSLVSNQWVVSAAHCFPREHSKEEYEVKLGAHQLDSFSNDIVVHTVAQIISHSSYREEGSQGDIALIRL
gi|13277969|  GGSLVSNQWVVSAAHCFPRTHSKEAYEVKLGAHQLDSYSNDTVVHTVAQIISHSSYREEGSQGDIALIRL
gi|13633203|  GGSLVSNQWVVSAAHCFPREHSKEAYEVKLGAHQLDSYSNDTVVHTVAQIISHSSYREEGSQGDIAFIRL

                   150       160       170       180       190       200       210
              ....|....|....|....|....|....|....|....|....|....|....|....|....|....|
NOV14a        SRPITFSRYIRPICLPAANASFPNGLHCTVTGWGHVAPSVSLLTPKPLQQLEVPLISRETCNCLYNIDAK
gi|4506153|   SRPITFSRYIRPICLPAANASFPNGLHCTVTGWGHVAPSVSLLTPKPLQQLEVPLISRETCNCLYNIDAK
gi|11181573|  SSPVTFSRYIRPICLPAANASFPNGLHCTVTGWGHVAPSVSLQTPRPLQQLEVPLISRETCSCLYNINAV
gi|13632973|  SSPVTFSRYIRPICLPAANASFPNGLHCTVTGWGHVAPSVSLQTPRPLQQLEVPLISRETCSCLYNINAV
gi|13277969|  SSPVTFSRYIRPICLPAANASFPNGLHCTVTGWGHVAPSVSLQTPRPLQQLEVPLISRETCSCLYNINAV
gi|13633203|  SSPVTFSRYIRPICLPAANASFPNGLHCTVTGWGHVAPSVSLQTPRPLQQLEVPLISRETCSCLYNINAV

                   220       230       240       250       260       270       280
              ....|....|....|....|....|....|....|....|....|....|....|....|....|....|
NOV14a        PEEPHFVQEDMLCAGYVEGGKDACQGDSGDPLSCPVEGLWYLTGIVSWGDACGARNRPGVYTLASSYASW
gi|4506153|   PEEPHFVQEDMLCAGYVEGGKDACQGDSGGPLSCPVEGLWYLTGIVSWGDACGARNRPGVYTLASSYASW
gi|11181573|  PEEPHTIQQDMLCAGYVKGGKDACQGDSGGPLSCPIEGLWYLAGIVSWGDACGAHNRPGVYTLTSTYASW
gi|13632973|  PEEPHTIQQDMLCAGYVKGGKDACQGDSGGPLSCPIEGLWYLAGIVSWGDACGAHNRPGVYTLISTYASW
gi|13277969|  PEEPHTIQQDMLCAGYVKGGKDACQGDSGGPLSCPIEGLWYLAGIVSWGDACGAHNRPGVYTLISTYASW
gi|13633203|  PEEPHTIQQDMLCAGYVKGGKDACQGDSGGPLSCPIEGLWYLAGIVSWGDACGAHNRPGVYTLISTYASW

                   290       300       310       320       330       340
              ....|....|....|....|....|....|....|....|....|....|....|....|...
NOV14a        IQSKVTELQPRVVPQTQESQPDSNLCGSHLAFSSAPAQGLLRPILFLPLGLALGLLSPWLSEH
gi|4506153|   IQSKVTELQPRVVPQTQESQPDSNLCGSHLAFSSAPAQGLLRPILFLPLGLALGLLSPWLSEH
gi|11181573|  IHHHVAELQPRVVPQTQESQPDGHLCNHHPVFSLAAAQKLSRPILFLPLGSLTLGLFSLWLEH-
gi|13632973|  IHHHVAELQPRAVPQTQESQPDGHLCNHHPVFSLAAAQKLSRPILFLPLGSLTLGLFSLWLEH-
gi|13277969|  IHHHVAELQPRVVPQTQESQPDGHLCNHHPVFSSAAAPKLLRPVLFLPLGLTLGLLSLA----
gi|13633203|  IHHHVAELQPRVVPQTQESQPDGHLCNHHPVFSSAAAPKLLRPILFLPLGLTLGLLSLWLEH-
```

Tables 14L and 14M list the domain description from DOMAIN analysis results against NOV14a. This indicates that the NOV14a sequence has properties similar to those of other proteins known to contain these domains.

TABLE 14L

Domain Analysis of NOV14a

```
gnl|Smartsmart00020, Tryp_SPc, Trypsin-like serine protease; Many of
these are synthesised as inactive precursor zymogens that are cleaved
during limited proteolysis to generate their active forms. A few,
however, are active as single chain molecules, and others are inactive
due to substitutions of the catalytic triad residues. (SEQ ID NO:155)
Length = 230 residues, 100.0% aligned
Score = 205 bits (522), Expect = 3e-54
NOV14a:   44 RITGGSSAVAGQWPWQVSITYE-GVHVCGGSLVSEQWVLSAAHCFPSE-------------   90
             || ||| |  | +|||||+ |  | | |||||+| +|||+||||
00020:     1 RIVGGSEANIGSFPWQVSLQYRGGRHFCGGSLISPRWVLTAAHCVYGSAPSSIRVRLGSH   60

NOV14a:   91 ------------------HHKGS----QGDIALLQLSRPTSYSRYIRPICLPAANASFPN  128
                               |   +      |||||+|| | + |  +||||||++  + |
00020:    61 DLSSGEETQTVKVSKVIVHPNYNPSTYDNDIALLKLSEPVTLSDTVRPICLPSSGYNVPA  120

NOV14a:  129 GLHCTVTGWGHVAPSVSLLTPKPLQQLEVPLISRETCNCLYNIDAKPEEPHFVQEDMVCA  188
             |  |||+|||  + | |   |  ||++ ||++|  ||   |           + ++|+||
00020:   121 GTTCTVSGWGTTSES-SGSLPDTLQEVNVPIVSNATCRRAY------SGGPAITDNMLCA  173

NOV14a:  189 GYVEGGKDACQGDSGDPLSCPVEGLWYLTGIVSWG-DACGARNRPGVYTLASSYASWI    245
             | +|||||||||||| || |     | | ||||||   |   |+|||||  |||  ||
00020:   174 GGLEGGKDACQGDSGGPLVCNDPR-WVLVGIVSWGSYGCARPNKPGVYTRVSSYLDWI    230
```

TABLE 14M

Domain Analysis of NOV14a

```
gnl|Pfam|pfam00089, trypsin, Trypsin. Proteins recognized include all
proteins in families S1, S2A, S2B, S2C, and S5 in the classsification
of peptidases. Also included are proteins that are clearly members,
but that lack peptidase activity, such as haptoglobin and protein Z
(PRTZ+). (SEQ ID NO:156)
Length = 217 residues, 100.0% aligned
Score = 177 bits (450), Expect = 6e-46
NOV14a:   45 ITGGSSAVAGQWPWQBSITYEGVHVCGGSLVSEQWVLSAAHCFPSEH-------------   91
             | ||  | || +|||||+     | |||||+|| |||+||||
00089:     1 IVGGREAQAGSFPWQVSLQVSSGHFCGGSLISENWVLTAAHCVSGASSVRVVLGEHNLGT   60

NOV14a:   92 ---------------HKG---SQGDIALLQLSRPTSYSRYIRPICLPAANASFPNGLHCT  133
                            |        |||||+|  | +    +||||||+|++  | |  |+
00089:    61 TEGTEQKFDVKKIIVHPNYNPDTNDIALLKLKSPVTLGDTVRPICLPSASSDLPVGTTCS  120

NOV14a:  134 VTGWGHVAPSVSLLTPKPLQQLEVPLISRETCNCLYNIDAKPEEPHFVQEDMVCAGYVEG  193
             |+|||      +| |   ||++ ||++|||||   |           | + |+|||   |
00089:   121 VSGWGRTK---NLGTSDTLQEVVVPIVSRETCRSAY--------GGTVTDTMICAGA-LG  168

NOV14a:  194 GKDACQGDSGDPLSCPVEGLWYLTGIVSWGDACGARNRPGVYTLASSYASWI          245
             |||||||||| || |       | ||||||  |   | |||||  | |  ||
00089:   169 GKDACQGDSGGPLVCSDG---ELVGIVSWGYGCAVGNYPGVYTRVSRYLDWI          217
```

Proteolytic enzymes that exploit serine in their catalytic activity are ubiquitous, being found in viruses, bacteria and eukaryotes (Rawlings N. D., Barrett A. J. Families of Serine Peptidases. Meth. Enzymol. 244: 19–61, 1994). They include a wide range of peptidase activity, including exopeptidase, endopeptidase, oligopeptidase and omega-peptidase activity. Over 20 families (denoted S1–S27) of serine protease have been identified, these being grouped into 6 clans on the basis of structural similarity and other functional evidence (Rawlings et al. 1994).

Tryptase is a tetrameric serine protease that is concentrated and stored selectively in the secretory granules of all types of mast cells, from which it is secreted during mast cell degranulation. Its exclusive presence in mast cells permits its use as a specific clinical indicator of mast cell activation by measurement of its level in biologic fluids and as a selective marker of intact mast cells using immunohistochemical techniques with antitryptase antibodies. Vanderslice (Vanderslice et al., Human mast cell tryptase: multiple cDNAs and genes reveal a multigene serine protease family. Proc. Nat. Acad. Sci. 87: 3811–3815, 1990) demonstrated the existence of multiple tryptases. In this respect, mast cell tryptase is like other serine proteases such as glandular kallikrein and trypsin, which are also members of multigene families.

Miller et al. (Miller et al., Cloning and characterization of a second complementary DNA for human tryptase. J. Clin. Invest. 86: 864–870, 1990) mapped both alpha-tryptase and beta-tryptase to human chromosome 16 by PCR analysis of DNA from human/hamster somatic cell hybrids. Miller et al. (1990) cloned a second cDNA for human tryptase, called beta-tryptase, from a mast cell cDNA library. The 1,142 bases of beta-tryptase were found to encode a 30-amino acid leader sequence of 3,089 daltons and a 245-amino acid catalytic region of 27,458 daltons. The amino acid sequence of beta-tryptase was found to be 90% identical with that of alpha-tryptase, the first 20 amino acids of the catalytic portions being 100% identical. Both alpha- and beta-tryptase sequences were localized to human chromosome 16 by analysis of DNA preparations from 25 human/hamster somatic cell hybrids by PCR.

Yu et al. have purified a novel human serine proteinase, designated as prostasin, from seminal fluid (Yu et al., Molecular cloning, tissue-specific expression, and cellular localization of human prostasin mRNA. J Biol Chem 270(22):13483–9, 1995). A full-length cDNA sequence encoding prostasin was obtained by amplification of the 5'- and 3'-ends of the cDNA. It contains a 1,032-base coding region, a 572-base 3'-noncoding region and a 138-base 5'-noncoding sequence. Prostasin cDNA encodes a protein of 343 amino acids, which consists of a 32-amino acid signal peptide and a 311-amino acid proprostasin. Proprostasin is then cleaved between Arg12 and Ile13 to generate a 12-amino acid light chain and a 299-amino acid heavy chain, which are associated through a disulfide bond. The deduced amino acid sequence of the heavy chain has 34–42% identity to human acrosin, plasma kallikrein, and hepsin. A potential N-glycosylation site at Asn127 and the catalytic triad of His53, Asp102, and Ser206 have been identified. The deduced prostasin has a unique 19-amino acid hydrophobic portion at the COOH terminus, which makes it suitable to anchor in the cell membrane. Carboxyl-terminal sequencing of purified prostasin indicates that the hydrophobic portion is removed and that there is a cleavage between Arg290 and Pro291 during secretion. Southern blot analysis, following a reverse transcription polymerase chain reaction, indicates that prostasin mRNA is expressed in prostate, liver, salivary gland, kidney, lung, pancreas, colon, bronchus, renal proximal tubular cells, and prostate carcinoma LNCaP cells. Cellular localization of prostasin mRNA was identified within epithelial cells of the human prostate gland by in situ hybridization histochemistry.

Because of the presence of the trypsin domains and the homology to the tryptase, we anticipate that the novel sequence described here will have useful properties and functions similar to these genes.

Human seminal fluid is a rich source of proteolytic enzymes, many of which are involved in the postejaculatory hydrolysis of proteins and in semen coagulation and liquefaction. Prostate-specific antigen and acrosin are two of the most important proteolytic enzymes found in human semen. Prostate-specific antigen may play an important role in semen liquefaction through hydrolyzing semenogelin, a predominant seminal vesicle protein. Prostate-specific antigen levels in blood have been recognized recently as the most important marker for prostate cancer. Acrosin is a serine proteinase present in acrosomes, where it covers the anterior part of the sperm head. It is believed to be involved in recognition, binding, and penetration of the zona pellucida of the ovum during interaction of the sperm and egg. The serine proteinase prostasin, has been identified and purified from human seminal fluid. At the present time, the physiological functions of prostasin are unknown, and its physiological substrate remains to be identified. Prostasin has an apparent molecular mass of 40 kDa on SDS-polyacrylamide gel electrophoresis and displays arginine amidolytic activity. The N-terminal 20-amino acid sequence of prostasin shares 50–55% identity with human alpha-tryptase, elastase 2A and 2B, chymotrypsin, acrosin, and the catalytic chains of hepsin, plasma kallikrein, and coagulation factor XI. It is present in many tissues and has the highest level in the prostate gland. In the prostate gland, prostasin has been localized in epithelial cells and ducts by immunohistochemistry. It is believed that prostasin is synthesized in prostatic epithelial cells, secreted into the ducts, and excreted into the seminal fluid, where it may serve a role in fertilization. The wide distribution of prostasin outside the prostate gland indicates that it may also play important roles in other biological processes. The full-length PRSS8 gene has been isolated and characterized. A 7-kb PRSS8 gene fragment has been sequenced, including a 1.4-kb 5'-flanking region, the 4.4-kb PRSS8 gene, and a 1.2-kb 3'-flanking region. The gene consists of six exons and five introns based on comparison with its cDNA sequence. The sizes of these exons are 417, 18, 163, 272, 167, and 899 bp, while those of the introns are 243, 1763, 271, 85, and 92 bp. A number of potential regulatory elements have been revealed in the 5'-flanking region, including an AP2 site, two erythroid-specific promoter elements, and a sterol regulatory element. In addition, there are a variant GC box and a variant AP1 site in the promoter region. The transcription initiation site of the PRSS8 gene has been defined at the G residue and its adjacent A residue in a sequence CTCATGACT, which is similar to an initiator element CTCANTCT. Between the transcription initiation site and these putative regulatory elements, there is an AC-rich repetitive sequence that spans over 300 bp. Human PRSS8 is a single-copy gene and has been localized on chromosome 16p11.2 by in situ hybridization.

The full-length cDNA sequence encoding prostasin contains a 1,032-base coding region, a 572-base 3'-noncoding region and a 138-base 5'-noncoding sequence. Prostasin cDNA encodes a protein of 343 amino acids, which consists of a 32-amino acid signal peptide and a 311-amino acid proprostasin. Proprostasin is then cleaved between Arg12 and Ile13 to generate a 12-amino acid light chain and a 299-amino acid heavy chain, which are associated through a disulfide bond. The deduced amino acid sequence of the heavy chain has 34–42% identity to human acrosin, plasma kallikrein, and hepsin. A potential N-glycosylation site at Asn127 and the catalytic triad of His53, Asp102, and Ser206 have been identified. The deduced prostasin has a unique 19-amino acid hydrophobic portion at the COOH terminus, which makes it suitable to anchor in the cell membrane. Carboxyl-terminal sequencing of purified prostasin indicates that the hydrophobic portion is removed and that there is a cleavage between Arg290 and Pro291 during secretion. Southern blot analysis, following a reverse transcription polymerase chain reaction, has indicated that prostasin mRNA is expressed in prostate, liver, salivary gland, kidney, lung, pancreas, colon, bronchus, renal proximal tubular cells, and prostate carcinoma LNCaP cells. Cellular localization of prostasin mRNA has been identified within epithelial cells of the human prostate gland by in situ hybridization histochemistry.

The broad existence of prostasin mRNA in human tissues suggests that it may have important biological functions. Localization of prostasin mRNA in the epithelial cells of the prostate gland indicates that prostasin is synthesized in the cells and then secreted into the ducts. The presence of prostasin in prostatic epithelial cells and ducts has been identified by immunohistochemistry. Since it is likely to be a membrane-bound serine proteinase, prostasin may be involved in some important processes on the surface of cell membranes, such as removal of propeptides from hormones and growth factors and the activation of proenzymes associated with membranes.

The above defined information for NOV14 suggests that this NOV14 protein may function as a member of a prostasin protein family. Therefore, the NOV14 nucleic acids and proteins of the invention are useful in potential therapeutic and diagnostic applications. For example, a cDNA encoding the NOV14 protein may be useful in gene therapy, and the NOV14 protein may be useful when administered to a subject in need thereof. By way of nonlimiting example, the compositions of the present invention will have efficacy for treatment of patients suffering from fertilization disorders, conditions resulting from defective removal of propeptides from hormones and growth factors and/or activation of proenzymes associated with membranes. The NOV14 nucleic acid encoding prostasin-like protein, and the prostasin-like protein of the invention, or fragments thereof, may further be useful in diagnostic applications, wherein the presence or amount of the nucleic acid or the protein are to be assessed.

NOV15

A disclosed NOV15 nucleic acid of 2940 nucleotides (designated CuraGen Acc. No. CG50153-01/AC025263__da2) encoding a novel Low Density Lipoprotein Receptor (LDLR)-like protein is shown in Table 15A. An open reading frame was identified beginning with an ATG initiation codon at nucleotides 1–3 and ending with a TAA codon at nucleotides 2938–2940. The start and stop codons are in bold letters in Table 15A.

TABLE 15A

| NOV15 Nucleotide Sequence |
|---|
| (SEQ ID NO:35) |
| **ATG**GCCACCGCGGCAACCTCACCCGCGCTGAAGCGGCTGGATCTGCGCGACCCTGCGGCTCTTTTCGAGACGCATGGAG |
| CGGAGGAGATCCGCGGGCTGGAGCGCCAGGTTCGGGCCGAGATCGAGCACAAGAAGGAGGAGCTGCGGCAGATGGTGGG |
| CGAACGGTACCGCGACCTGATCGAGGCGGCCGACACCATCGGCCAGATGCGCCGCTGCGCCGTGGGGCTAGTGGACGCC |
| GTGAAGGCCACCGACCAGTACTGCGCCCGCCTCCGCCAGGCCGGCTCGGCCGCGCCCCGGCCACCGCGGGCCCAGCAGC |
| CACAGCAGCCATCCCAAGAGAAGTTCTACAGCATGGCTGCCCAGATCAAGCTACTCTTAGAAATTCCGGAGAAGATCTG |
| GAGCTCGATGGAAGCCTCTCAGTGTCTCCACGCCACACAGCTCTACCTGCTCTGCTGCCACCTCCACAGCCTGCTCCAG |
| CTGGATTCTTCTAGTTCCCGATACAGTCCCGTCCTCTCCCCGGTTCCTATACTCATCCGGCAGGTGGCAGCCGCCAGCC |
| ACTTCCGGTCAACTATTCTGCATGAAAGCAAGATGTTGCTCAAATGCCAAGGTGTGTCTGACCAAGCTGTGGCCGAGGC |
| CCTGTGCTCTATAATGCTCTTAGAAGAGAGTTCTCCTCGCCAAGCCCTCACAGACTTCCTGCTGGCCAGAAAGGCAACT |
| ATTCAGAAACTTCTCAACCAGCCACACCATGGTGCTGGTATCAAGGCTCAGATTTGCTCATTAGTGGAGTTGCTGGCCA |
| CCACTCTGAAGCAAGCTCATGCCCTTTTCTACACTTTGCCAGAAGGACTGCTGCCAGATCCAGCCCTGCCATGTGGCTT |
| GCTCTTCTCTACTCTGGAGACCATCACAGGCCAGCATCCTGCCAAGGGCACTGGTGTCCTGCAGGAAGAGATGAAACTC |
| TGCAGCTGGTTTAAACACCTGCCAGCATCCATCGTCGAGTTCCAGCCAACACTCCGAACCCTTGCACATCCCATCAGTC |
| AGGAATACCTGAAAGACACGCTGCAGAAATGGATCCACATGTGTAATGAAGACATTAAAAATGGGATCACCAACCTGCT |
| CACAGCTGGGATGTGCTATGTCGGCGGCTTCTGGAGAAGCCGCTCTTGTTCTGGGAAGATATGATGCAGCAACTGTTCC |
| TTGACCGATTACAGACTCTGACAAAAGAAGGCTTTGACTCCATCTCCAGTAGCTCCAAGGAGCTCTTGGTTTCAGCTTT |
| GCAGGAACTTGAAAGCAGCACCAGCAACTCCCCTTCAAATAAGCACATCCACTTTGAGTACAACATGTCGCTCTTCCTC |
| TGGTCTGAGAGTCCTAATGACCTGCCTTCCGATGCGGCCTGGGTCAGCGTGGCAAACCGGGGTCAGTTAGGGGTCGCTG |
| GCCTCTCTATGAAAGCACAAGCCATCAGCCCTTGTGTACAGAACTTCTGTTCTGCCCTGGATTCTAAGCTGAAGGTTAA |
| ACTAGATGACCTCCTGGCTTACCTCCCCTCTGATGACTCATCACTGCCCAAGGACGTTTCTCCCACACAGGCCAAGAGT |
| TCTGCCTTTGACAGATACGCAGATGCGGGGACCGTGCAGGAGATGCTGCGGACTCAGTCCGTGGCATGCATCAAGCACA |
| TCGTGGACTGCATCCGGGCAGAGCTACAGAGCATTGAAGAAGGTGTGCAAGGGCAACAGGATGCCCTCAACAGTGCCAA |
| GCTGCACTCAGTTCTTTTCATGGCCAGACTCTGCCAGTCCCTGGGAGAGCTGTGCCCCCATCTGAAGCAGTGCATCCTG |
| GGAAAATCAGAGAGCTCAGAGAAACCAGCAAGGGAGTTTAGGGCTCTGAGAAAACAGGGAAAGGTGAAAACTCAGGAAA |
| TCATTCCTACACAGGCCAAGTGGCAAGAGGTTAAAGAAGTACTCCTCCAGCAGAGCGTGATGGGCTACCAGGTCTGGAG |
| CAGTGCAGTTGTGAAAGTTTTGATTCATGGATTCACCCAGTCATTACTTCTAGATGATGCTGGCTCAGTTCTGGCCACA |
| GCCACCAGCTGGGATGAGCTAGAAATTCAGGAGGAGGCAGAGTCTGGCAGCAGTGTCACATCCAAGATCCGACTCCCTG |
| CACAGCCGTCCTGGTATGTACAGTCCTTCCTGTTTAGTTTATGCCAGGAAATTAATCGGGTTGGAGGCCATGCCTTGCC |
| AAAGGTGACATTACAGGAGATGCTGAAAAGCTGTATGGTTCAAGTAGTAGCTGCCTATGAAAAACTCTCCGAAGAAAAA |

TABLE 15A-continued

| NOV15 Nucleotide Sequence |
| --- |
| CAGATTAAAAAAGAAGGTGCATTTCCAGTCACCCAGAACCGGGCGCTGCAGCTGCTTTATGAGCTGCGTTACCTCAACA |
| TTGTTCTGACAGCCAAGGGTGACGAGGTGAAGAGTAGCCGGAGCAAGCCAGACTCCAGAATTGAGAAAGTGACTGACCA |
| CCTGGAAGCCCTCATTGATCCATTTGACCTGGACGTTTTCACGCCACACCTCAACAGCAACCTTCATCGCCTGGTGCAG |
| CGAACTTCTGTTCTGTTTGGATTGGTGACTGGTACAGAGAATCAGCTCGCCCCCCGGAGCAGTACGTTCAACTCCCAAG |
| AACCCCATAACATCCTGCCGCTGGCATCCAGTCAGATCAGGTTTGGACTTCTCCCACTGAGCATGACAAGCACTCGAAA |
| GGCTAAATCAACCAGAAACATCGAAACAAAAGCTCAGGTTGTCCCCCCGGCACGCTCCACAGCTGGTGACCCGACAGTT |
| CCTGGCTCCTTGTTCAGACAGCTTGTCAGTGAAGAAGACAACACGTCTGCACCTTCATTATTCAAACTTGGCTGGCTCT |
| CTAGTATGACTAAG**TAA** |

The nucleic acid sequence of NOV15 maps to chromosome 17 and has 2804 of 2836 bases (98%) identical to a *Homo sapiens* KIAA1381 mRNA (gb:GENBANK-ID:AB037802|acc:AB037802.1) (E=0.0).

A NOV15 polypeptide (SEQ ID NO:36) encoded by SEQ ID NO:35 is 979 amino acid residues and is presented using the one letter code in Table 15B. Signal P, Psort and/or Hydropathy results predict that NOV15 does not contain a signal peptide and is likely to be localized at the mitochondrial matrix space and the microbody (peroxisome) with a certainty of 0.4824.

The NOV15 amino acid sequence has 804 of 980 amino acid residues (82%) identical to, and 878 of 980 amino acid residues (89%) similar to, a *Mus musculus* 980 amino acid residue LDLBP (ptnr:SPTREMBL-ACC:Q9Z160) (E=0.0).

NOV15 is expressed in at least the following tissues: ovaries, liver, epidermis, fibroblast and blood leukocytes. This information was derived by determining the tissue sources of the sequences that were included in the invention including but not limited to SeqCalling sources, Public EST sources, Literature sources, and/or RACE sources. In addition, NOV15 is predicted to be expressed in brain tissues because of the expression pattern of a closely related *Homo sapiens* KIAA1381 mRNA homolog (gb:GENBANK-ID:AB037802|acc:AB037802.1).

Possible small nucleotide polymorphisms (SNPs) found for NOV15 are listed in Table 15C.

TABLE 15B

| NOV15 protein sequence |
| --- |
| (SEQ ID NO:36) |
| MATAATSPALKRLDLRDPAALFETHGAEEIRGLERQVRAEIEHKKEELRQMVGERYRDLIEAADTIGQMRRCAVGLVDAVKAT |
| DQYCARLRQAGSAAPRPPRAQQPQQPSQEKFYSMAAQIKLLLEIPEKIWSSMEASQCLHATQLYLLCCHLHSLLQLDSSSSRY |
| SPVLSPVPILIRQVAAASHFRSTILHESKMLLKCQGVSKQAVAEALCSIMLLEESSPRQALTDFLLARKATIQKLLNQPHHGA |
| GIKAQICSLVELLATTLKQAHALFYTLPEGLLPDPALPCGLLFSTLETITGQHPAKGTGVLQEEMKLCSWFKHLPASIVEFQP |
| TLRTLAHPISQEYLKDTLQKWIHMCNEDIKNGITNLLMYVKSMKGLAGIRDAMWELLTNESTNHSWDVLCRRLLEKPLLFWED |
| MMQQLFLDRLQTLTKEGFDSISSSSKELLVSALQELESSTSNSPSNKHIHFEYNMSLFLWSESPNDLPSDAAWVSVANRGQLQ |
| VAGLSMKAQAISPCVQNFCSALDSKLKVKLDDLLAYLPSDDSSLPKDVSPTQAKSSAFDRYADAGTVQEMLRTQSVACIKHIV |
| DCIRAELQSIEEGVQGQQDALNSAKLHSVLFMARLCQSLGELCPHLKQCILGKSESSEKPAREFRALRKQGKVKTQEIIPTQA |
| KWQEVKEVLLQQSVMGYQVWSSAVVKVLIHGFTQSLLLDDAGSVLATATSWDELEIQEEAESGSSVTSKIRLPAQPSWYVQSF |
| LFSLCQEINRVGGHALPKVTLQEMLKSCMVQVVAAYEKLSEEKQIKKEGAFPVTQNRALQLLYDLRYLNIVLTAKGDEVKSSR |
| SKPDSRIEKVTDHLEALIDPFDLDVFTPHLNSNLHRLVQRTSVLFGLVTGTENQLAPRSSTFNSQEPHNILPLASSQIRFGLL |
| PLSMTSTRKAKSTRNIETKAQVVPPARSTAGDPTVPGSLFRQLVSEEDNTSAPSLFKLGWLSSMTK |

TABLE 15C

| SNPs | | | | |
|---|---|---|---|---|
| Variant | Nucleotide Position | Base Change | Amino Acid Position | Base Change |
| 13374274 | 2485 | A > G | 829 | Ser > Gly |

NOV15 also has homology to the amino acid sequences shown in the BLASTP data listed in Table 15D.

TABLE 15D

| BLAST results for NOV15 | | | | | |
|---|---|---|---|---|---|
| Gene Index/ Identifier | Protein/Organism | Length (aa) | Identity (%) | Positives (%) | Expect |
| gi\|15011849\|ref\|NP_038609.2\| (NM_013581) | low density lipoprotein B [*Mus musculus*] | 980 | 767/983 (78%) | 833/983 (84%) | 0.0 |
| gi\|7243143\|dbj\|BAA92619.1\| (AB037802) | KIAA1381 protein [*Homo sapiens*] | 961 | 858/935 (91%) | 859/935 (91%) | 0.0 |
| gi\|17459161\|ref\|XP_040307.2\| (XM_040307) | low density lipoprotein receptor defect B complementing [*Homo sapiens*] | 962 | 860/936 (91%) | 861/936 (91%) | 0.0 |
| gi\|11360291\|pir\|\|T50629 | hypothetical protein DKFZp762L1710.1 (fragment) [*Homo sapiens*] | 438 | 437/438 (99%) | 437/438 (99%) | 0.0 |
| gi\|15237322\|ref\|NP_197134.1\| (NC_003076) | low density lipoprotein B-like protein [*Arabidopsis thaliana*] | 1068 | 83/313 (26%) | 134/313 (42%) | 3e−17 |

The homology of these sequences is shown graphically in the ClustalW analysis shown in Table 15E.

Table 15E ClustalW Analysis of NOV15

1) NOV15 (SEQ ID NO:36)
2) gi|15011849|ref|NP_038609.2| (NM_013581) low density lipoprotein B [Mus musculus] (SEQ ID NO:157)
3) gi|7243143|dbj|BAA92619.1| (AB037802) KIAA1381 protein [Homo sapiens] (SEQ ID NO:158)
4) gi|17459161|ref|XP_040307.2| (XM_040307) low density lipoprotein receptor defect B complementing [Homo sapiens] (SEQ ID NO:159)
5) gi|11360291|pir|T50629 hypothetical protein DKFZp762L1710.1 (fragment) [Homo sapiens] (SEQ ID NO:160)
6) gi|15237322|ref|NP_197134.1| (NC_003076) low density lipoprotein B-like protein [Arabidopsis thaliana] (SEQ ID NO:161)

```
                        10        20        30        40        50        60        70
                ....|....|....|....|....|....|....|....|....|....|....|....|....|....|
NOV15           ----------MSTAVTSPALKRLDLRDPAALFETHGAEEIRGLERQVRAEIEHKKEELRQMVGERYRDLI
gi|15011849|    ----------MAAATASSALKRLDLRDPNALFETHGAEEIRGLERQVRAEIEHKKEELRQMVGERYRDLI
gi|7243143|     -----------ATAATSPALKRLDLRDPAALFETHGAEEIRGLERQVRAEIEHKKEELRQMVGERYRDLI
gi|17459161|    ----------MSTAATSPALKRLDLRDPAALFETHGAEEIRGLERQVRAEIEHKKEELRQMVGERYRDLI
gi|11360291|    ----------------------------------------------------------------------
gi|15237322|    MRMSSASAGEYRPSAVSLSSNGGGQRIAESLHRSKPMSEEEIMESATEKNIHDKKEELRQEVSTRYRDLI

                        80        90       100       110       120       130       140
                ....|....|....|....|....|....|....|....|....|....|....|....|....|....|
NOV15           EAADTIGQMRRCAVGLVDAVSATDQYCARLRQAGSAAPPPPRAQQPQSPSQEKFYSMAAQIKLLLEIPEH
gi|15011849|    EAADTIGQMRRCAEGLVDAVSATDQYCARLRQAGSVAPPVPRAPQPQPPS-EKFYSMAAQIKLLLEIPEK
gi|7243143|     EAADTIGQMRRCAVGLVLAVSATDQYCARLRQAGSAAPPPPRAQQPQSPSQEKFYSMAAQIKLLLEIPEK
gi|17459161|    EAADTIGQMRRCAVGLVDAVSATDQYCARLRQAGSAAPPPPRAQQPQSPSQEKFYSMAAQIKLLLEIPEK
gi|11360291|    ----------------------------------------------------------------------
gi|15237322|    SSALSIVHRSSLCESSSANSSSIHGNIRSSSSSSVPETPKLASLNSVSVS---VSGSSCSSSYLSSTPEN

                       150       160       170       180       190       200       210
                ....|....|....|....|....|....|....|....|....|....|....|....|....|....|
NOV15           IWSGMEASCLHATQLYLLCCHLHS-LLQLDSSSSS-----RYSFVLSPVPILIRQVAAASHFRSTILHES
gi|15011849|    IWSGMEASCHLQATQLYLLCCHLHS-LLQLDSSSS-----RYSFVLSRFPILIRQVAAASHFRSTILHES
gi|7243143|     IWSGMEASCCLHATQLYLLCCHLHS-LLQLDSSSS-----RYSFVLSRFPILIRQVAAASHFRSTILHES
gi|17459161|    IWSGMEASCCLHATQLYLLCCHLHS-LLQLDSSSS-----RYSFVLSRFPILIRQVAAASHFRSTILHES
gi|11360291|    ----------------------------------------------------------------------
gi|15237322|    IWGCSSESMFSESAGRSSRAQSSQQRSSSSSGCGGGVAEVDQSKSSSNSSSSEHSWQIVESSSSQSSQRS

                       220       230       240       250       260       270       280
                ....|....|....|....|....|....|....|....|....|....|....|....|....|....|
NOV15           KMLLKCQGVSDQAVAEALCSIMLLEESSPRQALTDFLLARKATICKLLNQPHHGAG--IKAQICSLVELL
gi|15011849|    KMLLKCQAVSDQAVAEALCSIMLLEESSPRQALTDFLLARKATICTLLNQSHHGAG--IKAQICSLVELL
gi|7243143|     KMLLKCQGVSDQAVAEALCSIMLLEESSPRQALTDFLLARKATICKLLNQPHHGAG--IKAQICSLVELL
gi|17459161|    KMLLKCQGVSDQAVAEALCSIMLLEESSPRQALTDFLLARKATICKLLNQPHHGAG--IKAQICSLVELL
gi|11360291|    ----------------------------------------------------------------------
gi|15237322|    HERSLDPSSGLGSYVSSALTSSASSSSLLDSESVSELSSDSSSTWSLSKSNACTGEDAGESVLVFSDSSS

                       290       300       310       320       330       340       350
                ....|....|....|....|....|....|....|....|....|....|....|....|....|....|
NOV15           ATTLKQAHALFYTLP--EGLLPDPALPCGLLFSTLETITGQHEA-KGTSVLQSEMKLCSWFKHLFASIVE
gi|15011849|    ATTLNQAHALFYTLP--EGVLPDPALPCGLLFSTLETITRQHETGKGISALQGEMKLCSWLKHLFTSIVE
gi|7243143|     ATTLKQAHALFYTLP--EGLLPDPALPCGLLFSTLETITGQHEAGKGTSVLQSEMKLCSWFKHLFASIVE
gi|17459161|    ATTLKQAHALFYTLP--EGLLPDPALPCGLLFSTLETITGQHEAGKGTSVLQSEMKLCSWFKHLFASIVE
gi|11360291|    ----------------------------------------------------------------------
gi|15237322|    QVSSGSVGESSLQALTDMPSFYKTISSTPPASQLFGGSPNPEEEVSLWKSFSSSSSSVMLILDKNDVSKS
```

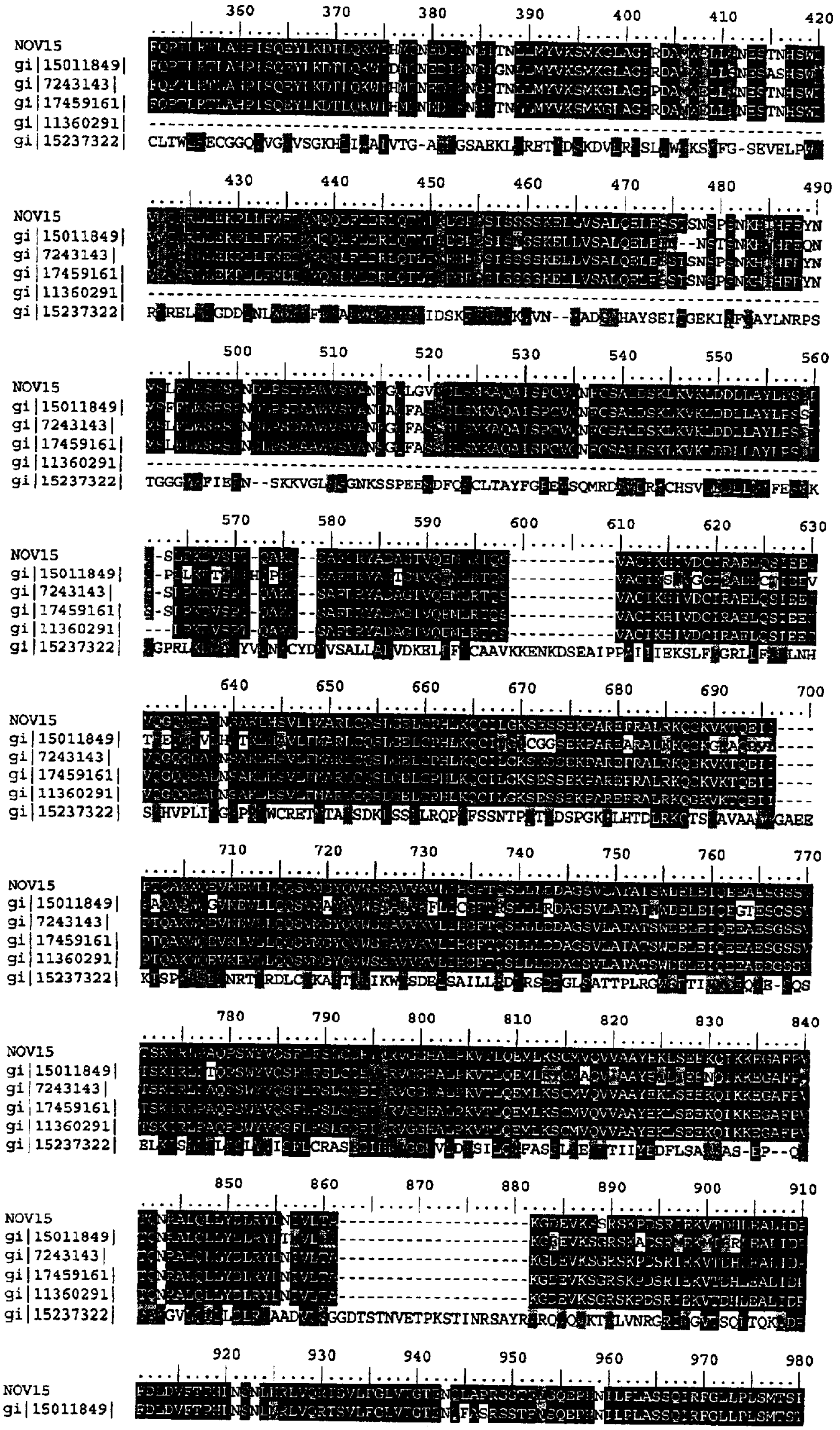
NOV15
gi|15011849|
gi|7243143|
gi|17459161|
gi|11360291|
gi|15237322|

```
gi|7243143|     FDLDVFIPHLNHNLHRLVQRTSVLFGLVTGTENQLAIRSSTPVSQEPHNILPLASSQIRFGLLPLSMTST
gi|17459161|    FDLDVFIPHLNHNLHRLVQRTSVLFGLVTGTENQLAIRSSTPVSQEPHNILPLASSQIRFGLLPLSMTST
gi|11360291|    FDLDVFIPHLNHNLHRLVQRTSVLFGLVTGTENQLAPRSSTPNSQEPHNILPLASSQIRFGLLPLSMTST
gi|15237322|    IDWLTSEPSLSENEKSSYLSHSVLFCFFVQLNSMYTDTSQKLSINIESNSSSCS-SVPSSKYLSSSAPSL

                         990       1000      1010      1020      1030      1040      1050
                ....|....|....|....|....|....|....|....|....|....|....|....|....|....|
NOV15           RKAKSI-RSIETKAQVVPP-------------APSTAGSPS-VPSSLFSQLASSEDNTSAPSL--------F
gi|15011849|    RKASSISRSSETSAQVGPP-------------ALSRVGSPSTHPSSLFSQLASSEDDSPAPSL--------F
gi|7243143|     RKAKSI-RSIETKAQVG---------------APSKR----------LIFGWSPTSHRASHDQSP------F
gi|17459161|    RKAKSI-RSIETKAQVG---------------APSKR----------LIFGWSPTSHRASHDQSP------F
gi|11360291|    RKAKSI-RSIETKAQVVPP-------------APSTAGSPS-VPSSLFSQLASSEDNTSAPSL--------F
gi|15237322|    SSRSSNKVSSPVTSNDASARNSWKAFTNGEQSSSSDLSENSNFSVASSSFSQLSSTLKLGSILTDGQVGIF

                         1060      1070      1080
                ....|....|....|....|....|....|..
NOV15           FLGWLSSVSK----------------------
gi|15011849|    FLAWLSSVSK----------------------
gi|7243143|     F-------------------------------
gi|17459161|    F-------------------------------
gi|11360291|    FLGWLSSVSK----------------------
gi|15237322|    FDRSASSSSTFGDILPAQAAGLLSSFTNTRSE
```

The Chinese hamster ovary (CHO) cell mutants ldlC and ldlB, which exhibit almost identical phenotypes, define two genes required for multiple steps in the normal medial and trans Golgi-associated processing of glycoconjugates (Chatterton J E, et al., Proc Natl Acad Sci USA 1999 Feb. 2;96(3):915–20). The LDLC gene encodes ldlCp, an approximately 80-kDa protein, which in wild-type, but not ldlB, cells associates reversibly with the cytoplasmic surface of the Golgi apparatus. Here, we have used a retrovirus-based expression cloning system to clone a murine cDNA, LDLB, that corrects the pleiotropic mutant phenotypes of ldlB cells. The corresponding mRNA was not detected in ldlB mutants. LDLB encodes an approximately 110-kDa protein, ldlBp, which lacks homology to known proteins and contains no common structural motifs. Database searches identified short segments of homology to sequences from *Drosophila melanogaster, Arabidopsis thaliana*, and *Caenorhabditis elegans*, and the essentially full-length homologous human sequence (82% identity); however, as was the case for ldlCp, no homologue was identified in *Saccharomyces cerevisiae*. We have found that in wild-type cell cytosols, ldlCp is a component of an approximately 950-kDa "ldlCp complex," which is smaller, approximately 700 kDa, in ldlB cytosols. Normal assembly of this complex is ldlBp-dependent and may be required for Golgi association of ldlCp and for the normal activities of multiple luminal Golgi processes. Mutations in the LDL receptor (LDLR) gene on chromosome 19 cause this disorder.

Familial hypercholesterolemia is characterized by elevation of serum cholesterol bound to low density lipoprotein (LDL) and is, hence, one of the conditions producing the hyperlipoproteinemia II phenotype. Heterozygotes develop tendinous xanthomas, corneal arcus, and coronary artery disease; the last usually becomes evident in the fourth or fifth decade. Homozygotes develop these features at an accelerated rate in addition to planar xanthomas, which may be evident at birth in the web between the first 2 digits.

The ranges of serum cholesterol and LDL-cholesterol are, in mg per dl, 250–450 and 200–400 in heterozygotes, greater than 500 and greater than 450 in homozygous affecteds, and 150–250 and 75–175 in homozygous unaffecteds, with some positive correlation with age (Khachadurian, Am. J. Med. 37: 402–407, 1964; Kwiterovich et al., J. Clin. Invest. 53: 1237–1249, 1974). Houlston et al. ((Letter) Lancet II: 405 only, 1988) studied the relationship of lipoprotein(a) levels and coronary heart disease in patients with familial hypercholesterolemia. Individuals with coronary artery disease had a significantly higher mean lipoprotein(a) concentration than those without coronary heart disease, suggesting that lipoprotein(a) measurements may help predict the risk of coronary heart disease in individuals with familial hypercholesterolemia. By studies of cultured fibroblasts from homozygotes, Goldstein and Brown (Proc. Nat. Acad. Sci. 70: 2804–2808,1973) and Brown and Goldstein (Proc. Nat. Acad. Sci. 71: 788–792,1974) showed that the basic defect concerns the cell membrane receptor for LDL. Normally, LDL is bound at the cell membrane and taken into the cell ending up in lysosomes where the protein is degraded and the cholesterol is made available for repression of microsomal enzyme 3-hydroxy-3-methylglutaryl coenzyme A (HMG CoA) reductase, the rate-limiting step in cholesterol synthesis. At the ame time, a reciprocal stimulation of cholesterol ester synthesis takes place. The same workers found that both receptor-absent and receptor-defective mutants occur and they concluded that some of the 'homozygotes' are in fact genetic compounds. An internalization mutant of the LDL receptor binds LDL but is unable to facilitate passage of LDL to the inside of the cell (Goldstein et al., Cell 12: 629–641,1977). A patient was found to be a genetic compound, having inherited the internalization mutant from the father and the binding mutant from the mother. From the fact that an individual was shown by family studies to be a genetic compound and that complementation did not occur, Goldstein et al. (1977) concluded that the gene for binding of LDL and the gene for internalization of LDL are allelic mutations at the structural locus for the LDL receptor. Miyake et al. (Proc. Nat. Acad. Sci. 78:5151–5155,1981) found homozygosity for the internalization defect. Harders-Spengel et al. (Proc. Nat. Acad. Sci. 79: 6355–6359,1982) presented evidence that the receptor defect is present on liver membranes. Levy et al. (Proc. Nat. Acad. Sci. 79: 6355–6359,1986) reported 2 brothers with a unique genetic compound form of 'homozygous' hypercholesterolemia in which the mother had typical FHC and the father and 3 of his close relatives had what they termed the HMWR (high molecular weight receptor) trait. In these persons 2 types of functional LDL receptors were found in cultured skin fibroblasts: one with normal molecular weight of 140,000 and one with molecular weight of 176,000. Curiously and puzzlingly, the compound heterozygotes and the regular heterozygotes for the HMWR showed increased cholesterol synthesis. Funahashi et al. (Hum. Genet. 79: 103–108,1988) studied 16 Japanese kindreds with homozygous FHC. Ten had a receptor-negative form of the disease; 5 had a receptor-defective form; and 1 represented an internalization defect. The receptor-defective group, in which functional receptors were produced, showed a lower tendency to coronary artery disease than the receptor-negative group. The receptor is synthesized as a 120-kD glycoprotein precursor that undergoes change to a 160-kD mature glycoprotein through the addition, apparently not of carbohydrate, but covalently of a 40-kD protein. In the 77 homozygotes studied by Goldstein (Personal Communication. Dallas, Tex., Jan. 4, 1983), all involved alterations in the structural gene for the 120-kD precursor (Tolleshaug et al., Cell 30: 715–724, 1982; Hobgood et al., (Abstract) Clin. Res. 31: 478A only, 1983). On the basis of size alone, he could identify 7 different mutations affecting the 120-kD precursor. About half of the 77 'homozygotes' are in fact genetic compounds. Jensen et al. (Ann. Hum. Genet. 63: 511–520,1999) studied 17 families with mutations in the LDLR gene as a model in which to test formally for linkage directly between an atherogenic genotype and ischemic heart disease or aorto-coronary calcified atherosclerosis. In each family, 1 of 3 different mutations was found: the trp66-to-gly mutation, the trp23-to-ter mutation, or a 10-kb deletion removing exons 3 through 6 of the LDLR gene. Genomic DNA was used to determine these mutations by either enzymatic cleavage assays or Southern blotting. The aorto-coronary calcification was significantly associated with age and plasma cholesterol. Sex, hypertension, body mass index, and smoking were not associated with the aorto-coronary calcification. Nonparametric analysis indicated significant linkage of the LDLR locus to aortic (p less than 0.00005) and to aorto-coronary calcified atherosclerosis (p less than 0.00001). Assuming a dominant mode of inheritance, significant linkage was detected for aortic (lod=3.89) and aorto-coronary calcified atherosclerosis (lod=4.10). Jensen et al. (1999) suggested that the atherogenicity of variations in other genes could be assessed by a similar approach.

Three independent linkage studies, by Ott et al. (Am. J. Hum. Genet. 26: 598–603,1974), Berg and Heiberg (Cytogenet. Cell Genet. 16: 266–270,1976), and Elston et al. (Cytogenet. Cell Genet. 16: 294–297,1976), strongly suggested loose linkage between familial hypercholesterolemia and the third component of complement; C3 has been mapped to chromosome 19 by somatic cell hybridization. Other studies of somatic hybrid cells suggested that the gene(s) for low density lipoprotein receptor may be on chromosome 5 or 21 or both ((Abstract) Cytogenet. Cell Genet. 32: 295–296, Maartmann-Moe et al., 1982). By family studies, Berg and Heiberg ((Abstract) Cytogenet. Cell Genet. 25: 136–137,1979) found a lod score of 4.0 for linkage with HLA at a recombination fraction of 0.14. Donald et al. ((Abstract) Cytogenet. Cell Genet. 37: 452 only, 1984) presented further data on HC-C3 linkage, bringing the combined male-female lod score to a maximum of 3.79 at theta 0.25. Francke et al. (Proc. Nat. Acad. Sci. 81: 2826–2830,1984) assigned the LDL receptor to chromosome 19 on the basis of expression studies in hamster-human somatic cell hybrids. [Francke et al. (1984) suggested that the locus should be designated LDLR for consistency with the policy of the Human Gene Mapping Workshops to name loci by the wildtype gene product when known.] It is interesting that both the receptor and one of its ligands (APOE) are on chromosome 19. C3 and FHC are about 20 cM apart; APOE and C3 are about 15 cM apart. FHC is not closely linked to APOE, suggesting that these 2 loci are on opposite sides of C3. Transferrin and transferrin receptor are both on chromosome 3. The LDLR gene was regionalized to 19p13.1–p13.3 by in situ hybridization (Lindgren et al., Proc. Nat. Acad. Sci. 82: 8567–8571,1985). Judging by the sequence of loci suggested by linkage data (pter-FHC-C3-APOE/APOC2), the location of FHC (LDLR) is probably 19p13.2–p13.12 and of C3, 19p13.2–p13.11. Humphries et al. (Lancet I: 1003–1005,1985) found a RFLP of the LDL receptor gene using the restriction enzyme PvuII. About 30% of persons are heterozygous for the polymorphism which is, therefore, useful in family studies and early diagnosis of FHC. Leppert et al. (Am. J. Hum. Genet. 39: 300–306, 1986) found tight linkage between a RFLP of the LDL receptor gene and dominantly inherited hypercholesterolemia; specifically, no exception to cosegregation was found between high-LDL cholesterol phenotype and a unique allele at the LDLR locus. The maximum lod score was 7.52 at theta=0. Li et al. (Nature 335: 414–417,1988) worked out a PCR method for analyzing DNA sequences in individual diploid cells and human sperm. They showed that 2 genetic loci could be coamplified from a single sperm, and proposed its use for genetic linkage studies. They analyzed the genotype of single sperm derived from an individual heterozygous at the LDLR locus and the HLA-DQ(alpha) locus and could show independent assortment. Individual sperm were drawn into a fine plastic needle under microscopic observation and delivered to a tube for lysis and amplification. Eighty individual sperm were analyzed for the study of independent assortment of LDLR and DQA. The method has great promise for fine mapping. Boehnke et al. (Am. J. Hum. Genet. 45: 21–32,1989) described the experimental design and issues of sample size to be considered in the application of the method to the generation of fine-structure human genetic maps. Atherogenic lipoprotein phenotype (108725) shows close linkage to the LDLR locus; indeed, the mutation(s) responsible for this phenotype may reside in the LDLR gene rather than in a separate, closely situated gene. Vaughan et al. (Genes Chromosomes Cancer 28: 133–137, 2000) described the cytogenetic analysis of an unusual giant cardiac lipoma that showed myocardial invasion, occurring in a patient with a history of multiple lipomatosis (151900). Cytogenetic studies of cells derived from the cardiac lipoma demonstrated no abnormalities at chromosome 12, but did reveal a t(2; 19)(p13;p13.2) translocation. FISH analyses assigned the p115-RhoGEF gene (601855) to 19q13.2–q13.3 and mapped the LDLR gene to 19p13.2, centromeric to the t(2;19) breakpoint. Thus, Vaughan et al. (2000) concluded that these genes are unlikely to be involved in the translocation found in this cardiac lipoma.

Russell et al. (Cell 37: 577–585,1984) demonstrated DNA sequence homology of the LDL receptor with the epidermal growth factor receptor (EGF; 131530). Sudhof et al.(Science 228: 815–822,1985) found that the gene for LDL receptor is more than 45 kb long and contains 18 exons, most of which correlate with functional domains previously defined at the protein level. Of the 18 exons, 13 encode protein sequences that are homologous to sequences in other proteins: 5 encode a sequence similar to one in C9 component of complement; 3 encode a sequence similar to a repeat sequence in the precursor for EGF and in 3 proteins of the blood clotting system—factor IX, factor X, and protein C, and 5 other exons encode nonrepeated sequences that are shared only with the EGF precursor. Since the LDL receptor is a mosaic protein built up of exons shared with different proteins, it is a member of several supergene families. Gilbert (Science 228: 823–824,1985) commented on the relevance of these findings to understanding the significance of 'split genes' and 'exon shuffling' during evolution. Horsthemke et al. (Europ. J. Biochem. 164: 77–81,1987) analyzed DNA from 70 UK patients with heterozygous familial hypercholesterolemia. In most, the restriction fragment pattern of the LDLR gene was indistinguishable from the normal; however, 3 patients were found to have a deletion of about 1 kb in the central portion of the gene. In 2 patients, the deletion included all or part of exon 5; in the third, the deletion included exon 7. Including a previously described patient with a deletion in the 3-prime part of the gene, these results indicated that 4 out of 70 patients, or 6%, have deletions. Langlois et al. (J. Hum. Genet. 43: 60–68,1988) screened 234 unrelated heterozygotes for FH to detect major rearrangements in the LDLR gene. Total genomic DNA was analyzed by Southern blot hybridization to probes encompassing exons 1 to 18 of the LDLR gene. Six different mutations were detected and characterized by use of exon-specific probes and detailed restriction mapping. The frequency of deletions in the Langlois et al. (1988) study was 2.5% (6 out of 234 patients). An illustration of previously mapped deletions and the deletions identified in this study (a total of 16) suggested that particular areas in the LDLR gene are susceptible to deletion. In a Japanese subject with homozygous hypercholesterolemia, Lehrman et al. (Cell 48:

827–835,1987) found a 7.8-kb deletion in LDLR. The deletion joined intron 15 to the middle of exon 18, which encodes the 3-prime untranslated region, thereby removing all 3-prime splice acceptor sites distal to intron 15. The mRNA should produce a truncated receptor that lacks the normal membrane-COOH terminus. The truncated protein was such that more than 90% of the receptor was secreted from the cell, and the receptors remaining on the surface showed defective internalization. The deletion resulted from recombination between 2 repetitive sequences of the Alu family, one in intron 15 and the other in exon 18. Lehrman et al. (1987) stated that Alu sequences had been found at the deletion joints of all 4 gross deletions that had been characterized in LDLR. Because of these and similar findings in connection with deletions in the gamma-delta-beta-globin cluster, recombination between Alu sequences appears to be a frequent cause of deletions in the human genome. Horsthemke et al. (1987) suggested that unequal crossing-over between 2 Alu-repetitive DNA sequences was responsible for an intragenic deletion of the LDLR gene leading to familial hypercholesterolemia. A 4-kb deletion had occurred between an Alu-repetitive sequence in intron 12 and a sequence in intron 14. The deletion eliminated exons 13 and 14 and changed the reading frame of the resulting spliced mRNA such that a stop codon was created in the following exon. The truncated receptor protein appeared to be rapidly degraded. The deletion was presumably caused by an unequal crossover event between 2 homologous chromosomes at meiosis. Alu sequences are widely scattered in the genome, being present in 300,000 to 500,000 copies. They have been described, for example, in the genes for alpha-globin (see 141800), gastrin (137250), gamma crystallin (123660), insulin-like growth factor II (147470), and soluble thymidine kinase. Each is about 300 bp long; thus Alu sequences represent about 3% of the total DNA. On the basis of structural similarity, the origin of Alu elements can be traced to the gene for 7SL RNA (Nature 312: 171–172, Ullu and Tschudi, 1984). The abundant cytoplasmic 7SL RNA functions in protein secretion as a component of the signal-recognition particle. This particle, consisting of 6 different polypeptides and 1 molecule of 7SL RNA, mediates the translocation of secretory proteins across the cytoplasmic reticulum. Although the 7SL RNA has a well-defined biologic function, that of the related Alu repeat remains unknown. Thus, the 7SL RNA gene may be a progenitor of a processed pseudogene, the Alu element, that has 'recently' spread to different locations in the human genome. The average Alu family member probably integrated into its present genomic location about 15–30 Myr ago. The Alu family is specific to primates, suggesting that these repeats were not present as little as 65 Myr ago. According to the Alu family copy number, one would, on the average, expect to find 1 such repeat every 3 to 5 kb in the human genome if they are randomly distributed. However, studies of the albumin/alpha-fetoprotein family by Ruffner et al. (Molec. Biol. Evol. 4: 1–9,1987) and of the thymidine kinase (188300) and beta-tubulin genes by Slagel et al. (Molec. Biol. Evol. 4: 19–29,1987) indicate clustering of Alu repeats in some parts of the genome. For example, the beta-tubulin gene has 10 of these repeats in less than 5 kb of a single intron and the thymidine kinase has 13 members within its introns in a region of about 10 kb. Hobbs et al. (New Eng. J. Med. 317: 734–737,1987) found a large deletion (more than 10 kb) in the LDLR gene in 63% of French Canadians with heterozygous FH. The deletion also occurred in homozygous form in 4 of 7 French-Canadian homozygotes. The deletion removed the promoter and first exon of the gene and abolished the production of mRNA for LDL receptor. The high frequency of the mutation was interpreted as representing founder effect; 8,000 ancestors account for present-day French Canadians and there has been relatively little outbreeding. The deletion has not been observed in any other ethnic group. It can be detected by analysis of genomic DNA from blood leukocytes, thus allowing direct diagnosis of FH in most affected French Canadians. Ma et al. (Clin. Genet. 36: 219–228,1989) identified a second 'French Canadian' LDLR gene deletion which was found in 4 of 80 heterozygotes (5%). The mutation consisted of a 5-kb deletion removing exons 2 and 3 of the LDLR gene, which corresponded to the first 2 repeats of the LDLR-binding domain. Hobbs et al. (J. Clin. Invest. 81: 909–917,1988) found that 16 of 132 cell strains (12%) from persons with the clinical syndrome of homozygous familial hypercholesterolemia synthesized no immunodetectable LDL receptor protein, indicating the presence of 2 mutant genes that failed to produce crossreacting material (CRM-negative mutants). DNA and mRNA from all but one of these CRM-negative patients were available for study. Haplotype analysis based on 10 RFLPs suggested that the 30 CRM-negative genes represented by these 15 individuals had included 13 different mutant alleles. Four of the alleles produced no mRNA; 3 of these 4 had large deletions ranging from 6 to 20 kb that eliminated the promoter region of the gene. The reason for the lack of mRNA in the fourth allele was not apparent. Three alleles encoded mRNAs of abnormal size. One of the abnormal mRNAs was produced by a gene harboring a deletion, and another was produced by a gene with a complex rearrangement. The third abnormal-sized mRNA (3.1 kb larger than normal) was produced by an allele that had no detectable alteration as judged by Southern blotting. The other 6 mRNA-positive alleles appeared normal by Southern blotting and produced normal-sized mRNA but no receptor protein. Among 20 mutant LDL receptor genes, Yamakawa et al. (Hum. Genet. 82: 317–321,1989) found 4 different deletion mutations (20%). None of these had been reported previously in Caucasians. Three of them were novel and one was similar to a previously described Japanese mutation. In 3 of the 4 deletions, the rearrangements were related to intron 15 in which there are many Alu sequences. Leitersdorf et al. (J. Clin. Invest. 85: 1014–1023,1990) analyzed the LDL receptor genes of 11 French-Canadian FH homozygotes. Only 3 different LDLR haplotypes were identified, and the coding region of the allele associated with each was sequenced. Three different missense mutations were found. Assays developed to detect each of these directly were applied to 130 FH heterozygotes from the greater Montreal area. The common deletion responsible for about 60% of cases (Hobbs et al., 1987) and the smaller deletion identified by Ma et al. (1989) and found in about 5% of French Canadians were also sought. They were able to detect LDL receptor mutations in 76% of the subjects and 14% had 1 of the 3 missense mutations. In the Saguenay-Lac St. Jean region of Quebec province, De Braekeleer (Hum. Hered. 41: 141–146,1991) estimated the prevalence of familial hypercholesterolemia as 1/122, compared to the usually used frequency of 1/500 for European populations. Yamakawa et al. (Hum. Genet. 80: 1–5,1988) described a TaqI polymorphism in the LDLR gene which should be useful in the study of FH. Leitersdorf et al. (Am. J. Hum. Genet. 44: 409–421,1989) used 10 different RFLPs to construct 123 differing haplotypes from 20 pedigrees. The 5 most common haplotypes accounted for 67.5% of the sample. Heterozygosity and polymorphism information content (PIC) for each site were determined. Hobbs et al. (Annu.

Rev. Genet. 24: 133–170,1990) reviewed the many mutations found in the LDLR gene. Rudiger et al. (Europ. J. Biochem. 198: 107–111,1991) reviewed previously described deletions in the LDLR gene in cases of familial hypercholesterolemia and reported the finding of a deletion in 3 of 25 unrelated patients with FH. Two of these were equivalent to previously described LDLR alterations, thus supporting a notion of recombination hotspots which involve Alu sequences. In at least 4 cases (FH626, PO, JA, and FH-DK3), a deletion of exon 5 of the LDLR gene has been found as the defect responsible for FH. The FH626 mutation was characterized by Hobbs et al. (J. Biol. Chem. 261: 13114–13120,1986) and found to involve Alu repeat sequences in introns 4 and 5. Rudiger et al. (1991) characterized FH-DK3 and likewise found involvement of 2 Alu repeated sequences present in introns 4 and 5. The crossover breakpoints involve sequences similar to those reported for FH626 but not at identical positions in the 5-prime end. By use of denaturing gradient gel electrophoresis (DGGE) in combination with PCR, Top et al. (Hum. Genet. 89: 561–565,1992) found no evidence of a promoter mutation in the LDLR gene in 350 heterozygotes for FH. Hobbs et al. (Hum. Mutat. 1: 445–466,1992) reviewed 71 mutations in the LDL receptor gene that had been characterized at the molecular level and added 79 additional mutations. Furthermore, they reviewed the insight that all 150 mutations provided into the structure/function relationship of the receptor protein and the clinical manifestations of FH. Wilson et al. (Am. J. Cardiol. 81: 1509–1511,1998) described an online database of LDLR mutations. Lee et al. (Am. J. Cardiol. 81: 1509–1511,1998) studied 80 unrelated individuals with FH from the West of Scotland. Microsatellite analysis using D19S394 was informative in 20 of 23 families studied. In these families, there was no inconsistency with segregation of the FH phenotype with the LDLR locus. Using SSCP, Lee et al. (J. Med. Genet. 35: 573–578, 1998) also detected mutations in exon 4 of the LDLR gene in 15 of 80 of these individuals; 7 of 15 had the same cys163-to-tyr mutation (143890.0058). Lee et al. (1998) concluded that microsatellite analysis using D19S394 is useful in tracking the LDLR gene in families and could be used in conjunction with LDL cholesterol levels to diagnose FH, especially in children and young adults, in whom phenotypic diagnosis can be difficult. Knoblauch et al. (Am. J. Hum. Genet. 66: 157–166,2000) studied an Arab family that carried the tyr807-to-cys substitution (143890.0019). In this family, some heterozygous persons had normal LDL levels, while some homozygous individuals had LDL levels similar to those persons with heterozygous FH. The authors presented evidence for the existence of a cholesterol-lowering gene on 13q (604595).

Davis et al. (Cell 45: 15–24,1986) found that substitution of cysteine for tyrosine in the cytoplasmic domain of LDL receptors impedes their internalization. Lehrman et al. (1985) found that genes with nonsense and frameshift mutations that truncated the cytoplasmic domain resulted in internalization-defective LDL receptors. Hobbs et al. (1986) described an LDL receptor mutant in which 1 of the 7 repeating units constituting the ligand binding domain had been deleted. The deletion arose by homologous recombination by repetitive Alu sequences in intron 4 and intron 5 of the gene. The deletion removed exon 5, which normally encodes the sixth repeat of the ligand binding domain. In the resultant mRNA, exon 4 was found to be spliced to exon 6, preserving the reading frame. The resulting shortened protein reaches the cell surface and reacts with antireceptor antibodies but does not bind LDL. It does, however, bind VLDL, a lipoprotein that contains apoprotein E as well as apoprotein B-100. The findings in this instructive case support the hypothesis that the 7 repeated sequences in the receptor constitute the LDL binding domain, that the sixth repeat is required for binding of LDL but not of VLDL, and that deletion of a single repeat can alter the binding specificity of the LDL receptor. Sass et al. (Hum. Genet. 96: 21–26,1995) described a 4-generation French-Canadian kindred with familial hypercholesterolemia in which 2 of the 8 heterozygotes for a 5-kb deletion (exons 2 and 3) in the LDLR gene were found to have normal LDL-cholesterol levels. Analyses showed that it was unlikely that variation in the genes encoding apolipoprotein B, HMG-CoA reductase, apoAI-CIII-AIV, or lipoprotein lipase was responsible for the cholesterol-lowering effect. Expression of the LDL receptor, as assessed in vitro with measurements of activity and mRNA levels, was similar in normolipidemic and hyperlipidemic subjects carrying the deletion. Analysis of the apoE isoforms, on the other hand, revealed that most of the E2 allele carriers in this family, including the 2 normolipidemic 5-kb deletion carriers, had LDL cholesterol levels substantially lower than subjects with the other apoE isoforms. Thus, this kindred provided evidence for the existence of a gene or genes, including the apoE2 allele, with profound effects on LDL-cholesterol levels. In a 13-year-old girl with severe hypercholesterolemia, Ekstrom et al. (Clin. Genet. 55: 332–339,1999) demonstrated compound heterozygosity for a cys240-to-phe mutation (143890.0059) and a tyr167-to-ter mutation (143890.0045) in the LDLR gene. Her 2 heterozygous sibs also carried the C240F mutation, but only one of them was hypercholesterolemic. The authors concluded that there may be cholesterol-lowering mechanisms that are activated by mutations in other genes.

Feussner et al. (Am. J. Med. Genet. 65: 149–154,1996) described a 20-year-old man with a combination of heterozygous FH caused by splice mutation (143890.0054) and type III hyperlipoproteinemia (107741). He presented with multiple xanthomas of the elbows, interphalangeal joints and interdigital webs of the hands. Active lipid-lowering therapy caused regression of the xanthomas and significant decrease of cholesterol and triglycerides. Flat xanthomas of the interdigital webs were described in 3 of 4 formerly reported patients with a combination of these disorders of lipoprotein metabolism. Feussner et al. (1996) proposed that the presence of these xanthomas should suggest compound heterozygosity (actually double heterozygosity) for FH and type III hyperlipoproteinemia. Varret et al. (Nucleic Acids Res. 25: 172–180,1997) described a database of LDLR genes and provided a listing of the 210 mutations it contained as of the fall of 1996. Vergopoulos et al. (Europ. J. Hum. Genet. 5: 315–323, 1997) presented findings suggesting the existence of a xanthomatosis-susceptibility gene in a consanguineous Syrian kindred containing 6 individuals with homozygous FH (see 602247). Half of the homozygotes had giant xanthomas, while half did not, even though their LDL-cholesterol concentrations were elevated to similar degrees (more than 14 mmol/l). Heterozygous FH individuals in this family were also clearly distinguishable with respect to xanthoma size. By DNA analysis they identified a hitherto undescribed mutation in the LDLR gene in this family: a T-to-C transition at nucleotide 1999 in codon 646 of exon 14, resulting in an arginine for cysteine substitution. Segregation analysis suggested that a separate susceptibility gene may explain the formation of giant xanthomas. In homozygous familial hypercholesterolemia, the aortic root is prone to develop therosclerotic plaque at an early age. Such plaques can accumulate in unusual sites, such as the ascending aorta and around the coronary ostia. Summers et al. (Circulation 98: 509–518,1998) evaluated the aortic root using MRI imaging in a blinded, prospective study of 17 homozygous FH patients and 12 healthy controls. When patient age and body mass index were taken into account, 53% of patients with homozygous FH had increased aortic wall thickness compared to controls; this was thought to result from a combination of medial hyperplasia and plaque formation. Supravalvular aortic stenosis was seen in 41% of patients.

Hepatitis C virus (HCV), the principal viral cause of chronic hepatitis, is not readily replicated in cell culture systems, making it difficult to ascertain information on cell receptors for the virus. However, several observations from studies on the role of HCV in mixed cryoglobulinemia provided some insight into HCV entry into cells. Evidence indicated that HCV and other viruses enter cells through the mediation of LDL receptors: by the demonstration that endocytosis of these viruses correlates with LDL receptor activity, by complete inhibition of detectable endocytosis by anti-LDL receptor antibody, by inhibition with anti-apolipoprotein E and anti-apolipoprotein B antibodies, by chemical methods abrogating lipoprotein/LDL receptor interactions, and by inhibition with the endocytosis inhibitor phenylarsine oxide. Agnello et al. (Proc. Nat. Acad. Sci. 96: 12766–12771,1999) provided confirmatory evidence by the lack of detectable LDL receptor on cells known to be resistant to infection by one of these viruses, bovine viral diarrheal virus (BVDV). Endocytosis via the LDL receptor was shown to be mediated by complexing of the virus to very low density lipoprotein (VLDL) or LDL, but not high density lipoprotein (HDL). Studies using LDL receptor-deficient cells or a cytolytic BVDV system indicated that the LDL receptor may be the main but not exclusive means of cell entry of these viruses.

Compactin is a potent competitive inhibitor of 3-hydroxy-3-methylglutaryl coenzyme-A reductase and may prove useful in the treatment of hypercholesterolemia (Betteridge et al., Lancet II: 1342–1343 1978). Starzl et al. (Lancet I: 1382–1383, 1984) performed both heart transplant and liver transplant in a 6.75-year-old girl with homozygous familial hypercholesterolemia.

Wilson et al. (Hum. Gene Therapy 3: 179–222,1992) presented a detailed clinical protocol for the ex vivo gene therapy of familial hypercholesterolemia. The approach, which they proposed to use to treat homozygous FH patients with symptomatic coronary artery disease who have a relatively poor prognosis but can tolerate a noncardiac surgical procedure with acceptable risks, involves recovery of hepatocytes from the patient and reimplanting them after genetic correction by a retrovirus-mediated gene transfer. Not only were the technical details of vectors and viruses, transduction and delivery of hepatocytes, evaluation of engraftment and rejection, etc., discussed, but also assessment of risks versus benefits and informed consent for both adult and child patients.

Tonstad et al. (J. Pediat. 129: 42–49,1996) conducted a double-blind placebo-controlled trial over 1 year using 8 grams of cholestyramine in prepubertal children (aged 6–11 years) with familial hypercholesterolemia. After 1 year of a low-fat, low-cholesterol diet, children with a family history of premature cardiovascular disease had LDL cholesterol levels at or greater than 4.9 mmol/liter, while children without such a family history had LDL cholesterol levels at or greater than 4. 1 mmol/liter. The LDL cholesterol levels in the test group lowered by 16.9% (95% confidence interval), compared with a 1.4% increase in the placebo group.

Growth velocity was not adversely affected in the treatment group, although folate and 25-hydroxyvitamin D deficiency were noted among a small number of treated children. Additionally, a boy who had an appendectomy 3 months before the study required surgery for intestinal obstruction after he had taken the first 2 cholestyramine doses. Given the number of gastrointestinal side effects, Tonstad et al. (1996) recommended caution in starting cholestyramine after abdominal surgery in children.

In most populations the frequency of the homozygote is 1 in a million (probably a minimal estimate, being a prevalence figure rather than incidence at birth) and the frequency of heterozygotes not less than 1 in 500. Thus, heterozygous familial hypercholesterolemia is the most frequent mendelian disorder, being more frequent than either cystic fibrosis or sickle cell anemia which, in different populations, are often given that distinction. Among survivors of myocardial infarction, the frequency of heterozygotes is about 1 in 20.

Seftel et al. (Brit. Med. J. 281: 633–636,1980) pointed to a high frequency of hypercholesterolemic homozygotes in South Africa. In a 7-year period, 34 homozygotes were seen in one clinic in Johannesburg. All were Afrikaners and most lived in Transvaal Province. The authors calculated the frequency of heterozygotes and homozygotes to be 1 in 100 and 1 in 30,000, respectively. The oldest of their patients was a 46-year-old woman. Of the 34, six were age 30 or older. The authors concluded that the high frequency of the gene is attributable to founder effect, as in the case of porphyria variegata, lipoid proteinosis, and sclerosteosis. Torrington and Botha (Lancet II: 1120 only, 1981) found that 20 of 26 families with FHC (77%) belonged to the Gereformeerde Kerk, whereas according to the 1970 census only 5% of the Afrikaans-speaking white population of South Africa belonged to this religious group. Again, the data were consistent with a founder effect. Using the LDLR activity of lymphocytes, Steyn et al. (J. Med. Genet. 26: 32–36,1989) calculated the prevalence of heterozygous FHC in the permanent residents of a predominantly Afrikaans-speaking community in South Africa to be 1 in 71—the highest prevalence reported to date.

Like the French Canadians, the South Afrikaners appear to have a unique form of mutation in the LDLR gene consistent with founder effect (Brink et al., Hum. Genet. 77: 32–35,1987). Because of the presumed role of founder effect on the high frequency of familial hypercholesterolemia in South Africa, it is not surprising that Kotze et al. (J. Med. Genet. 24: 750–755,1987) found a predominance of 2 haplotypes in 27 informative families with FH. In a study of homozygotes from the Afrikaner population in South Africa, Leitersdorf et al. (1989) found that 2 mutations account for more than 95% of the mutant LDL receptor genes. Both mutations were basepair substitutions that resulted in a single amino acid change and both could be detected readily with PCR and restriction analysis. The findings were considered consistent with the high frequency of FH being due to founder effect. Graadt van Roggen et al. (Hum. Genet. 88: 204–208,1991) studied the prevalence and distribution of the 3 common mutations in South Africa in 27 unrelated homozygous and 79 unrelated heterozygous FH Afrikaner patients from 2 regions of South Africa, the Transvaal and Cape Provinces. The 3 mutations were FH Afrikaner-1 (143890.0006), FH Afrikaner-2 (143890.0009), and FH Afrikaner-3 (143890.0044).

The relative distribution of each of the 3 mutations was similar in the 2 regions, with frequencies of 66, 27, and 7%, respectively. Defects other than the 3 common mutations were more frequent in the Cape than in the Transvaal; thus, the 3 known mutations accounted for 98% of FH alleles in the Transvaal nd only 74% in the Cape Province. None of the patients carried the familial apolipoprotein B-100 mutation.

Schuster et al. (Clin. Genet. 48: 90–92, 1995) identified yet another homozygote for the val408-to-met mutation (143890.0009), a 12-year-old Greek boy living in Germany. The mutation was present in both his parents, his brother, grandmother, uncle, and cousin. The haplotype, using 6 RFLPs of the LDL receptor gene, was different from the one reported earlier in Afrikaner and Dutch FH patients. Schuster et al. (1995) concluded that the mutation in the Greek boy probably occurred independently. Furthermore, they speculated that, because the parents were from different areas in Greece, the mutation may be common in Greeks.

In the Saguenay-Lac St. Jean region of Quebec province, De Braekeleer (1991) estimated the prevalence of familial hypercholesterolemia as 1/122, compared to the usually used frequency of 1/500 for European populations.

Defesche and Kastelein (Lancet 352: 1643–1644,1998) stated that more than 350 different mutations had been found in patients with familial hypercholesterolemia. They tabulated the preferential geographic distribution that has been demonstrated for some of the LDL receptor mutations. For example, in the West of Scotland about half of the index cases of FH were found to have the cys163-to-tyr mutation (143890.0058). Defesche and Kastelein (1998) commented on the geographic associations of LDL receptor mutations within the Netherlands.

Kingsley and Krieger (Proc. Nat. Acad. Sci. 81: 5454–5458,1984) identified 4 different types of mutant Chinese hamster ovary cells with defective LDL receptor function. One locus, called ldlA, apparently represents the structural gene for LDL receptor, whereas the others—ldlB, ldlC, and ldlD—appear to have defects involved in either regulation, synthesis, transport, recycling, or turnover of LDL receptors.

The Watanabe heritable hyperlipidemic (WHHL) rabbit has a genetic deficiency of LDL receptors and is therefore a superb experimental model (Hornick et al., Proc. Nat. Acad. Sci. 80: 6096–6100, 1983). Kita et al. (Proc. Nat. Acad. Sci. 84: 5928–5931,1987) found that probucol prevented the progression of atherosclerosis in the Watanabe rabbit by limiting oxidative LDL modification and foam cell transformation of macrophages. Probucol was originally developed as an antioxidant. Yamamoto et al. (1986) showed that the defect in the Watanabe heritable hyperlipidemic rabbit is a mutant receptor for LDL that is not transported to the cell surface at a normal rate. Cloning and sequencing of complementary cDNAs from normal and Watanabe rabbits showed that the defect arises from an in-frame deletion of 12 nucleotides that eliminates 4 amino acids from the cysteine-rich ligand binding domain of the LDL receptor. Yamamoto et al. (1986) detected a similar mutation by S1 nuclease mapping of LDL receptor mRNA from a patient with familial hypercholesterolemia whose receptor also failed to be transported to the cell surface. These findings suggested to Yamamoto et al. (Science 232: 1230–1237,1986) that animal cells may have fail-safe mechanisms that prevent surface expression of improperly folded proteins with unpaired or improperly bonded cysteine residues.

Scanu et al. (J. Lipid Res. 29: 1671–1681,1988) investigated hypercholesterolemia due to deficiency of the LDL receptor in a family of rhesus monkeys. Hummel et al. (Proc. Nat. Acad. Sci. 87: 3122–3126,1990) used PCR to analyze the mutation carried by members of a family of rhesus monkeys with spontaneous hypercholesterolemia and low density lipoprotein receptor deficiency. Affected monkeys are heterozygous for a nonsense mutation in exon 6, changing codon 284 from TGG to TAG. The G-to-A transition creates a new SpeI restriction site. LDLR RNA is reduced by about 50% on quantitative analysis of RNA obtained at liver biopsy in affected animals.

Hofmann et al. (Science 239: 1277–1281,1988) found that overexpression of LDL receptors caused elimination of both apoe and apoB, the 2 ligands, from the plasma in transgenic mice derived from fertilized eggs injected with the LDLR gene under control of the mouse metallothionein-I promoter. They speculated that overexpression of other receptors, such as those for insulin (147670) or transferrin (190000), might have pathologic effects leading to a 'ligand steal' syndrome.

Frank et al. (Genomics 5: 646–648,1989) identified RFLPs of the mouse LDL receptor gene and used them to map the gene, designated Ldlr, to the proximal region of chromosome 9. Using interspecific backcrosses, they established the order and interval distances for this and several other loci on mouse chromosome 9, namely, APOA4 (107690), which is on chromosome 11 in man, and mannosephosphate isomerase (1154550), which is on chromosome 15 in man.

Roy Chowdhury et al. (Science 254: 1802–1805,1991) used the Watanabe rabbit for the development of liver-directed gene therapy based on transplantation of autologous hepatocytes that had been genetically corrected ex vivo with recombinant retroviruses. Animals transplanted with LDLR-transduced autologous hepatocytes demonstrated a 30 to 50% decrease in total serum cholesterol that persisted for the duration of the experiment (1122 days). Recombinant-derived LDLR RNA was harvested from tissues with no diminution for up to 6.5 months after transplantation. Ishibashi et al. (J. Clin. Invest. 92: 883–893,1993) developed a new animal model for homozygous FH through targeted disruption of the LDLR gene in mice. Homozygous LDL receptor-deficient mice showed delayed clearance of VLDL, intermediate density lipoproteins (IDL), and LDL from plasma. As a result, total plasma cholesterol level rose from 108 mg/dl in wildtype mice to 236 mg/dl in homozygous deficient mice. Adult mice did not exhibit gross evidence of xanthomatosis, however, and the extent of aortic atherosclerosis was minimal. On the other hand, Ishibashi et al. (J. Clin. Invest. 93: 1885–1893,1994) showed that in mice homozygous for the targeted disruption of the LDLR gene who were fed a diet high in cholesterol, total plasma cholesterol rose from 246 to more than 1,500 mg/dl. In wildtype littermates fed the same diet, total plasma cholesterol remained less than 160 mg/dl. After 7 months, the homozygous deficient mice developed massive xanthomatous infiltration of the skin and subcutaneous tissue. The aorta and coronary ostia exhibited gross atheromata, and the aortic valve leaflets were thickened by cholesterol-laden macrophages.

The above defined information for NOV15 suggests that this NOV15 protein may function as a member of a Low Density Lipoprotein Receptor (LDLR) protein family. Therefore, the NOV15 nucleic acids and proteins of the invention are useful in potential therapeutic and diagnostic applications. For example, a cDNA encoding the NOV15 protein may be useful in gene therapy, and the NOV15 protein may be useful when administered to a subject in need thereof. By way of nonlimiting example, the compositions of the present invention will have efficacy for treatment of patients suffering from Familial hypercholesterolemia; hyperlipoproteinemia II phenotype; tendinous xanthomas; corneal arcus; coronary artery disease; planar xanthomas; webbed digits; hypercholesterolemia; fertility; coronary artery disease; diabetics; atherosclerosis; xanthomatosis; Hepatitis C infection; regulation, synthesis, transport, recycling, or turnover of LDL receptors; Cerebral arteriopathy with subcortical infarcts and leukoencephalopathy; Epiphyseal dysplasia, multiple 1; Ichthyosis, nonlamellar and nonerythrodermic, congenital; Leukemia, T-cell acute lymphoblastoid; Pseudoachondroplasia; SCID, autosomal recessive, T-negative/B-positive type; C3 deficiency; Diabetes mellitus, insulin-resistant, with acanthosis nigricans; Glutaricaciduria, type I; Hypothyroidism, congenital; Leprechaunism; Liposarcoma; Mucolipidosis IV; Persistent Mullerian duct syndrome, type I; Rabson-Mendenhall syndrome; Thyroid carcinoma, nonmedullary, with cell oxyphilia; Erythrocytosis, familial; Malaria, cerebral, susceptibility to; Bleeding disorder due to defective thromboxane A2 receptor; Cerebellar ataxia, Cayman type; Convulsions, familial febrile, 2; Cyclic hematopoiesis; Fucosyltransferase-6 deficiency; GAMT deficiency; Von Hippel-Lindau (VHL) syndrome; Cirrhosis; Transplantation; Psoriasis; Actinic keratosis; Tuberous sclerosis; Acne; Hair growth; allopecia; pigmentation disorders and/or endocrine disorders. The NOV15 nucleic acid encoding Low Density Lipoprotein Receptor (LDLR)-like protein, and the Low Density Lipoprotein Receptor (LDLR)-like protein of the invention, or fragments thereof, may further be useful in diagnostic applications, wherein the presence or amount of the nucleic acid or the protein are to be assessed.

NOV16

NOV16 includes a Tumor necrosis factor receptor (TNFR)-like protein and a TNF Receptor Associated Factor 5 (TRAF 5)-like disclosed below. The disclosed proteins have been named NOV16a and NOV16b, respectfully.

NOV16a

A disclosed NOV16a nucleic acid of 1787 nucleotides (designated CuraGen Acc. No. CG56108-01) encoding a novel Tumor necrosis factor receptor (TNFR)-like protein is shown in Table 16A. An open reading frame was identified beginning with an ATG initiation codon at nucleotides 7–9 and ending with a TAG codon at nucleotides 1711–1713. Putative untranslated regions upstream from the initiation codon and downstream from the termination codon are underlined in Table 16A, and the start and stop codons are in bold letters.

TABLE 16A

| NOV16a Nucleotide Sequence |
| --- |
| (SEQ ID NO:37) |
| <u>CCCACA</u>**ATG**GCTTATTCAGAAGAGCATAAAGGTATGCCCTGTGGTTTCATCCGCCAGAATTCCGGCAACTCCATTTCCT |
| TGGACTTTGAGCCCAGTATAGAGTACCAGTTTGTGGAGCGGTTGGAAGAGCGCTACAAATGTGCCTTCTGCCACTCGGT |
| GCTTCACAACCCCCACCAGACAGGATGTGGGCACCGCTTCTGCCAGCACTGCATCCTGTCCCTGAGAGAATTAAACACA |
| GTGCCAATCTGCCCTGTAGATAAACAGGTCATCAAATCTCAGCAGGTTTTTAAAGACAATTGTTGCAAAAGAGAAGTCC |
| TCAACTTATATGTATATTGCAGCAATGCTCCTGGATGTAATGCCAAGGTTATTCTGGGCCGGTACCAGCAGGTCCCACT |
| GGCCTGTTGTTATCTGTTGCAGGATCACCTTCAGCAGTGCTTATTTCAACCTGTGCAGTGTTCTAATGAGAAGTGCCGG |
| GAGCCAGTCCTACGGAAAGACCTGAAAGAGCATTTGAGTGCATCCTGTCAGTTTCGAAAGGAAAAATGCCTTTATTGCA |
| AAAAGGATGTGGTAGTCATCAATCTACAGAATCATGAGGAAAACTTGTGTCCTGAATACCCACTATTTTGTCCCAACAA |
| TTGTGCGAAGATTATTCTAAAAACTGAGGTAGATGAACACCTGGCTGTATGTCCTGAAGCTGAGCAAGACTGTCCTTTT |
| AAGCACTATGGCTGTGCTGTAACGGATAAACGGAGGAACCTGCAGCAACATGAGCATTCAGCCTTACGGGAGCACATGC |
| GTTTGGTTTTAGAAAAGAATGTCCAATTAGAAGAACAGATTTCTGACTTACACAAGAGCCTAGAACAGAAAGAAAGTAA |
| AATCCAGCAGCTAGCAGAAACTATAAAGAAACTTGAAAAGGAGTTCAAGCAGTTTGCACAGTTGTTTGGCAAAAATGGA |
| AGCTTCCTCCCAAACATCCAGGTTTTTGCCAGTCACATTGACAAGTCAGCTTGGCTAGAAGCTCAAGTGCATCAATTAT |
| TACAAATGGTTAACCAGCAACAAAATAAATTTGACCTGAGACCTTTGATGGAAGCAGTTGATACAGTGAAACAGAAAAT |
| TACCCTGCTAGAAAACAATGATCAAAGATTAGCCGTTTTAGAAGAGGAAACTAACAAACATGATACCCACATTAATATT |
| CATAAAGCACAGCTGAGTAAAAATGAAGAGCGATTTAAACTGCTGGAGGGTACTTGCTATAATGGAAAGCTCATTTGGA |
| AGGTGACAGATTACAAGATGAAGAAGAGAGAGGCGGTGGATGGGCACACAGTGTCCATCTTCAGCCAGTCCTTCTACAC |
| CAGCCGCTGTGGCTACCGGCTCTGTCCTACAGCATACCTGAATGGGGATGGGTCAGGGAGGGGGTCACACCTGTCCCTA |
| TACTTTGTGGTCATGCGAGGAGAGTTTGACTCACTGTTGCAGTGGCCATTCAGGCAGAGGGTGACCCTGATGCTTCTGG |
| ACCAGACTGGCAAAAAGAACATTATGGAGACCTTCAAACCTGACCCCAATAGCAGCAGCTTTAAAAGACCTGATGGGGA |
| GATGAACATTGCATCTGGCTGTCCCCGCTTTGTGGCTCATTCTGTTTTGGAGAATGCCAAGAACGCCTACATTAAAGAT |
| GACACTCTGTTCTTGAAAGTGGCCGTGGACTTAACTGACCTGGAGGATCTC**TAG**<u>TCACTGTTATGGGGTGATAAGAGGA</u> |
| <u>CTTCTTGGGGCCAGAACTGTGGAGGAGAGCACATTTGATTATCATATTG</u> |

The nucleic acid sequence of NOV16a maps to chromosome 1q32 and has 1376 of 1379 bases (99%) identical to a *Homo sapiens* TRAF5 mRNA (gb:GENBANK-ID:AB000509|acc:AB000509.1) (E=0.0).

A NOV16a polypeptide (SEQ ID NO:38) encoded by SEQ ID NO:37 is 568 amino acid residues and is presented using the one letter code in Table 16B. Signal P, Psort and/or Hydropathy results predict that NOV16a does not contain a signal peptide and is likely to be localized in the cytoplasm with a certainty of 0.4500.

TABLE 16B

| NOV16a protein sequence |
|---|
| (SEQ ID NO:38) |
| MAYSEEHKGMPCGFIRQNSGNSISLDFEPSIEYQFVERLEERYKCAFCHSVLHNPHQTGCGHRFCQHCILSLRELNTVPICPV |
| DKEVIKSQEVFKDNCCKREVLNLYVYCSNAPGCNAKVILGRYQQVPLACCYLLQDHLQQCLFQPVQCSNEKCREPVLRKDLKE |
| HLSASCQFRKEKCLYCKKDVVVINLQNHEENLCPEYPVFCPNNCAKIILKTEVDEHLAVCPEAEQDCPFKHYGCAVTDKRRNL |
| QQHEHSALREHMRLVLEKNBQLEEQISDLHKSLEQKESKIQQLAETIKKLEKEFKQFAQLFGKNGSFLPNIQVFASHIDKSAW |
| LEAQVHQLLQMVNQQQNKFDLRPLMEAVDTVKQKITLLENNDQRLAVLEEETNKHDTHINIHKAQLSKNEERFKLLEGTCYNG |
| KLIWKVTDYKMKKREAVDGHTVSIFSQSFYTSRCGYRLCARAYLNGDGSGRGSHLSLYFVVMRGEFDSLLQWPFRQRVTLMLL |
| DQSGKKNIMETFKPDPNSSSFKRPDGEMNIASGCPRFVAHSVLENAKNAYIKDDTLFLKVAVDLTDLEDL |

The NOV16a amino acid sequence has 557 of 568 amino acid residues (98%) identical to, and 557 of 568 amino acid residues (98%) similar to, a *Homo sapiens* 557 amino acid residue TRAF5 (TNF RECEPTOR ASSOCIATED FACTOR 5) (ptnr:SPTREMBL-ACC:O00463) (E=1.4e$^{-307}$).

NOV16a is expressed in at least the following tissues: Aorta, Brain, Cartilage, Chorionic Villus, Dermis, Lymphoid tissue, Pituitary Gland, Retina, Thymus, Tonsils and Uterus. This information was derived by determining the tissue sources of the sequences that were included in the invention including but not limited to SeqCalling sources, Public EST sources, Literature sources, and/or RACE sources.

NOV16b

A disclosed NOV16b nucleic acid of 1661 nucleotides (designated CuraGen Acc. No. CG56108-02) encoding a novel TNF Receptor Associated Factor 5 (TRAF5)-like protein is shown in Table 16C. An open reading frame was identified beginning with an ATG initiation codon at nucleotides 7–9 and ending with a TAG codon at nucleotides 1585–1587. Putative untranslated regions upstream from the initiation codon and downstream from the termination codon are underlined in Table 16C, and the start and stop codons are in bold letters.

TABLE 16C

| NOV16b Nucleotide Sequence |
|---|
| (SEQ ID NO:49) |
| CCCACA**ATG**GCTTATTCAGAAGAGCATAAAGGTATGCCCTGTGGTTTCATCCGCCAGAATTCCGGCAACTCCATTTCCT |
| TGGACTTTGAGCCCAGTATAGAGTACCAGTTTGTGGAGCGGTTGGAAGAGCGCTACAAATGTGCCTTCTGCCACTCGGT |
| GCTTCACAACCCCCACCAGACAGGATGTGGGCACCGCTTCTGCCAGCACTGCATCCTGTCCCTGAGAGAATTAAACACA |
| GTGCCAATCTGCCCTGTAGATAAAGAGGTCATCAAATCTCAGGAGGTTTTTAAAGACAATTGTTGCAAAAGAGAAGTCC |
| TCAACTTATATGTATATTGCAGCAATGCTCCTCGATGTAATGCCAAGGTTATTCTGGGCCGGTACCAGGATCACCTTCA |
| GCAGTGCTTATTTCAACCTGTGCAGTGTTCTAATGAGAAGTGCCGGGAGCCAGTCCTACGGAAAGACCTGAAAGAGCAT |
| TTGAGTGCATCCTGTCAGTTTCGAAAGGAAAAATGCCTTTATTGCAAAAAGGATGTGGTAGTCATCAATCTACAGAATC |
| ATGAGGAAAACTTGTGTCCTGAATACCCAGTATTTTGTCCCAACAATTGTGCGAAGATTATTCTAAAAACTGAGGTAGA |
| TGAACACCTGGCTGTATGTCCTGAAGCTGAGCAAGACTGTCCTTTTAAGACTATGGCTCTGCTGTAACGATTTCTGAC |
| TTACACAAGAGCCTAGAACAGAAAGAAAGTAAAATCCAGCAGCTAGCAGAAACTATAAAGAAACTTGAAAAGGAGTTCA |
| AGCAGTTTGCACAGTTGTTTGGCAAAAATGGAAGCTTCCTCCCAAACATCCAGGTTTTTGCCAGTCACATTCACAACTC |

TABLE 16C-continued

| NOV16b Nucleotide Sequence |
|---|
| AGCTTGGCTAGAAGCTCAAGTGCATCAATTATTACAAATGGTTAACCAGCAACAAAATAAATTTGACCTGAGACCTTTG |
| ATGGAAGCACTTGATACAGTGAAACAGAAAATTACCCTGCTAGAAAACAATGATCAAAGATTAGCCGTTTTAGAAGAGG |
| AAACTAACAAACATGATACCCACATTAATATTCATAAACCACAGCTGAGTAAAAATGAAGAGCGATTTAAACTGCTGGA |
| GGGTACTTGCTATAATGGAAAGCTCATTTGGAACCTGACAGATTACAAGATGAAGAAGAGAGAGGCGGTCGATGGGCAC |
| ACAGTGTCCATCTTCAGCCAGTCCTTCTACACCAGCCGCTGTGGCTACCGGCTCTGTGCTAGAGCATACCTGAATGGCC |
| ATGGGTCAGGGAGGGGGTCACACCTGTCCCTATACTTTGTGGTCATGCGAGGAGAGTTTGACTCACTGTTGCAGTGGCC |
| ATTCAGGCAGAGGGTGACCCTGATGCTTCTGGACCAGAGTGGCAAAAAGAACATTATGGAGACCTTCAAACCTGACCCC |
| AATAGCAGCAGCTTTAAAAGACCTGATGGGGAGATGAACATTGCATCTGGCTGTCCCCGCTTTGTGGCTCATTCTGTTT |
| TGGAGAATGCCAAGAACGCCTACATTAAAGATGACACTCTGTTCTTGAAAGTGGCCGTGGACTTAACTGACCTGGAGGA |
| TCTC**TAG**TCACTGTTATGGGGTGATAAGAGGACTTCTTGGGGCCAGAACTGTGGAGGAGAGCACATTTGATTATCATAT |
| TG |

The nucleic acid sequence of NOV16b maps to chromosome 1q32 and has 1013 of 1051 bases (96%) identical to a *Homo sapiens* TRAF5 mRNA (gb:GENBANK-ID:AB000509|acc:AB000509.1) (E=0.0).

A NOV16b polypeptide (SEQ ID NO:50) encoded by SEQ ID NO:49 is 526 amino acid residues and is presented using the one letter code in Table 16D. Signal P, Psort and/or Hydropathy results predict that NOV16b contains a signal peptide and is likely to be localized to the cytoplasm with a certainty of 0. 4500.

The NOV16b amino acid sequence has 326 of 421 amino acid residues (77%) identical to, and 348 of 421 amino acid residues (82%) similar to, a *Homo sapiens* 557 amino acid residue TRAF5 (TNF receptor associated factor 5) (ptnr:SPTREMBL-ACC:O00463) (E=$7.2e^{-162}$).

Possible small nucleotide polymorphisms (SNPs) found for NOV16a are listed in Table 16E.

TABLE 16D

| NOV16b protein sequence |
|---|
| (SEQ ID NO:50) |
| MAYSEEHKGMPCGFIRQNSGNSISLDFEPSIEYQFVERLEERYKCAFCHSVLHNPHQTGCGHRFCQHCILSLRELNTVPICPV |
| DKEVIKSQEVFKDNCCKREVLNLYVYCSNAPGCNAKVILGRYQDHLQQCLFQPVQCSNEKCREPVLRKDLKEHLSASCQFRKE |
| KCLYCKKDVVVINLQHEENLCPEYPVFCPNNCAKIILKTEVDEHLAVCPEAEQDCPFKHYGCAVTISDLHKSLEQKESKIQQ |
| LAETIKKLEKEFKQFAQLFGKNGSFLPNIQVFASHIDKSAWLEAQVHQLLQMVNQQQNKFDLRPLMEAVDTVKQKITLLENND |
| QRLAVLEEETNKHDTHINIHKAQLSKNEERFKLLEGTCYNGKLIWKVTDYKMKKREAVDGHTVSIFSQSFYTSRCGYRLCARA |
| YLNGDGSCRCSHLSLYFVVMRGEFDSLLQWPFRQRVTLMLLDQSGKKNIMETFKPDPNSSSFKRPDGEMNIASGCPRFVAHSV |
| LENAKNAYIKDDTLFLKVAVDLTDLEDL |

TABLE 16E

| SNPs | | | | |
|---|---|---|---|---|
| Variant | Nucleotide Position | Base Change | Amino Acid Position | Base Change |
| 13375596 | 1402 | A > G | 466 | Arg > Gly |

NOV16a and NOV16b are very closely homologous as is shown in the amino acid alignment in Table 16F.

Table 16F Amino Acid Alignment of NOV16a and NOV16b

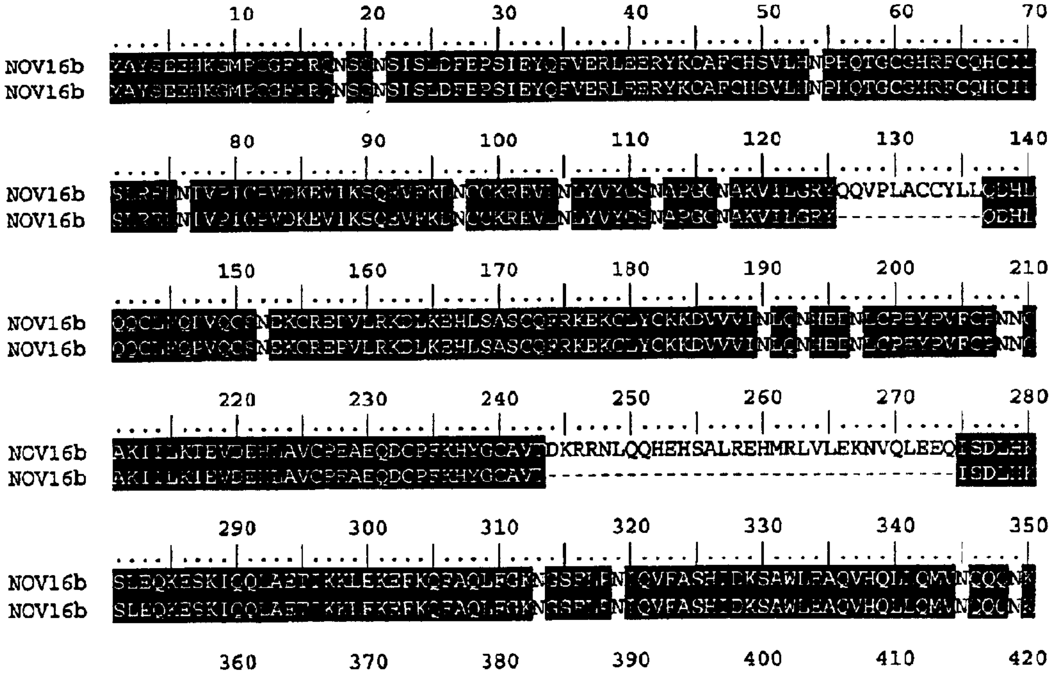

```
              10        20        30        40        50        60        70
         ....|....|....|....|....|....|....|....|....|....|....|....|....|....|
NOV16b   YAYEEHKGMPCGFIRQNSQNSISLDFEPSIEYQFVERLEERYKCAFCHSVLHNPHQTGCHRFCQHCII
NOV16b   YAYEEHKGMPCGFIRQNSQNSISLDFEPSIEYQFVERLEERYKCAFCHSVLHNPHQTGCHRFCQHCII

              80        90       100       110       120       130       140
         ....|....|....|....|....|....|....|....|....|....|....|....|....|....|
NOV16b   SLRFINIVPICEVDKEVIKSQEVPKINCCKREVLNYVYCSNAPGCNAKVILGRYQQVPLACCYLLDHL
NOV16b   SLRFINIVPICEVDKEVIKSQEVPKINCCKREVLNYVYCSNAPGCNAKVILGRY---------DHL

             150       160       170       180       190       200       210
         ....|....|....|....|....|....|....|....|....|....|....|....|....|....|
NOV16b   QQCLFQIVQCSNEXCREPVLRKDLKEHLSASCQFRKEKCLYCKKDVVVINLQNHEENLCPEYPVFCFNN
NOV16b   QQCLFQEVQCSNEXCREPVLRKDLKEHLSASCQFRKEKCLYCKKDVVVINLQNHEENLCPEYPVFCFNN

             220       230       240       250       260       270       280
         ....|....|....|....|....|....|....|....|....|....|....|....|....|....|
NOV16b   AKIILKTEVDEHIAVCPEAEQDCPEKHYGCAVTDKRRNLQQHEHSALREHMRLVLEKNVQLEEQISDLH
NOV16b   AKIILKIEVDEHIAVCPEAEQDCPEKHYGCAVT------------------------------ISDLH

             290       300       310       320       330       340       350
         ....|....|....|....|....|....|....|....|....|....|....|....|....|....|
NOV16b   SLEQKESKIQQLAETIKKLEKEFKQFAQLEGKASSPLFNIQVFASHIDKSAWLFAQVHQLIQMVNQQN
NOV16b   SLEQKESKIQQLAETIKKLEKEFKQFAQLEGKNSSPLFNIQVFASHIDKSAWLFAQVHQLLQMVNQQN
```

```
          ....|....|....|....|....|....|....|....|....|....|....|....|....|....|
NOV16b    FDLRPLMEAVDTVKQKITLLENNDQRLAVLEEETNKHDTHINIHKAQLSHNEERFKLLEGTCYNGKLIWH
NOV16b    FDLRPLMEAVDTVKQKITLLENNDQRLAVLEEETNKHDTHINIHKAQLSHNEERFKLLEGTCYNGKLIWH

                  430       440       450       460       470       480       490
          ....|....|....|....|....|....|....|....|....|....|....|....|....|....|
NOV16b    VTDYKMKKRFAVDGHTVSIFSQSFYTSRCGYRLCAPAYINGDGSGRGSHLSLYFVVMRGEFDSLLQWPFK
NOV16b    VTDYKMKKRFAVDGHTVSIFSQSFYTSRCGYRLCAPAYINGDGSGRGSHLSLYFVVMRGEFDSLLQWPFK

                  500       510       520       530       540       550       560
          ....|....|....|....|....|....|....|....|....|....|....|....|....|....|
NOV16b    QRVTLMLLDQSGKKNIMETFKPDPNSSSFKRPDGEMNIASGCPRFVAHSVLENAKNAYIKDDTLFLKVAV
NOV16b    QRVTLMLLDQSGKKNIMETFKPDPNSSSFKRPDGEMNIASGCPRFVAHSVLENAKNAYIKDDTLFLKVAV

          ....|...
NOV16b    DLTDLEDL
NOV16b    DLTDLEDL
```

Homologies to any of the above NOV16 proteins will be shared by the other NOV16 proteins insofar as they are homologous to each other as shown above. Any reference to NOV16 is assumed to refer to both of the NOV16 proteins in general, unless otherwise noted.

NOV16a also has homology to the amino acid sequences shown in the BLASTP data listed in Table 16G.

TABLE 16G

BLAST results for NOV16a

| Gene Index/ Identifier | Protein/Organism | Length (aa) | Identity (%) | Positives (%) | Expect |
|---|---|---|---|---|---|
| gi\|11321603\|ref\|NP_004610.1\| (NM_004619) | TNF receptor-associated factor5 [*Homo sapiens*] | 557 | 557/568 (98%) | 557/568 (98%) | 0.0 |
| gi\|2138180\|gb\|AAC51329.1\|(U69108) | TNF receptor associated factor5 [*Homo sapiens*] | 538 | 538/549 (97%) | 538/549 (97%) | 0.0 |
| gi\|1549146\|dbj\|BAA11942.1\|(D83528) | TRAF5 [*Mus musculus*] | 558 | 445/569 (78%) | 497/569 (87%) | 0.0 |
| gi\|6755867\|ref\|NP_035763.1\| (NM_011633) | TNF receptor-associated factor5 [*Mus musculus*] | 558 | 444/569 (78%) | 496/569 (87%) | 0.0 |
| gi\|14754079\|ref\|XP_040913.1\| (XM_040913) | TNF receptor-associated factor3 [*Homo sapiens*] | 568 | 232/562 (41%) | 354/562 (62%) | e−17 |

The homology of these sequences is shown graphically in the ClustalW analysis shown in Table 16H.

Table 16H ClustalW Analysis of NOV16a

1) NOV16a (SEQ ID NO:38)
2) gi|11321603|ref|NP_004610.1| (NM_004619) TNF receptor-associated factor5 [Homo sapiens] (SEQ ID NO:162)
3) gi|2138180|gb|AAC51329.1|(U69108)TNF receptor associated factor5 [Homo sapiens] (SEQ ID NO:163)
4) gi|1549146|dbj|BAA11942.1|(D83528)TRAF5 [Mus musculus] (SEQ ID NO:164)
5) gi|6755867|ref|NP_035763.1| (NM_011633)TNF receptor-associated factor5 [Mus musculus] (SEQ ID NO:165)
6) gi|14754079|ref|XP_040913.1| (XM_040913)TNF receptor-associated factor3 [Homo sapiens] (SEQ ID NO:166)
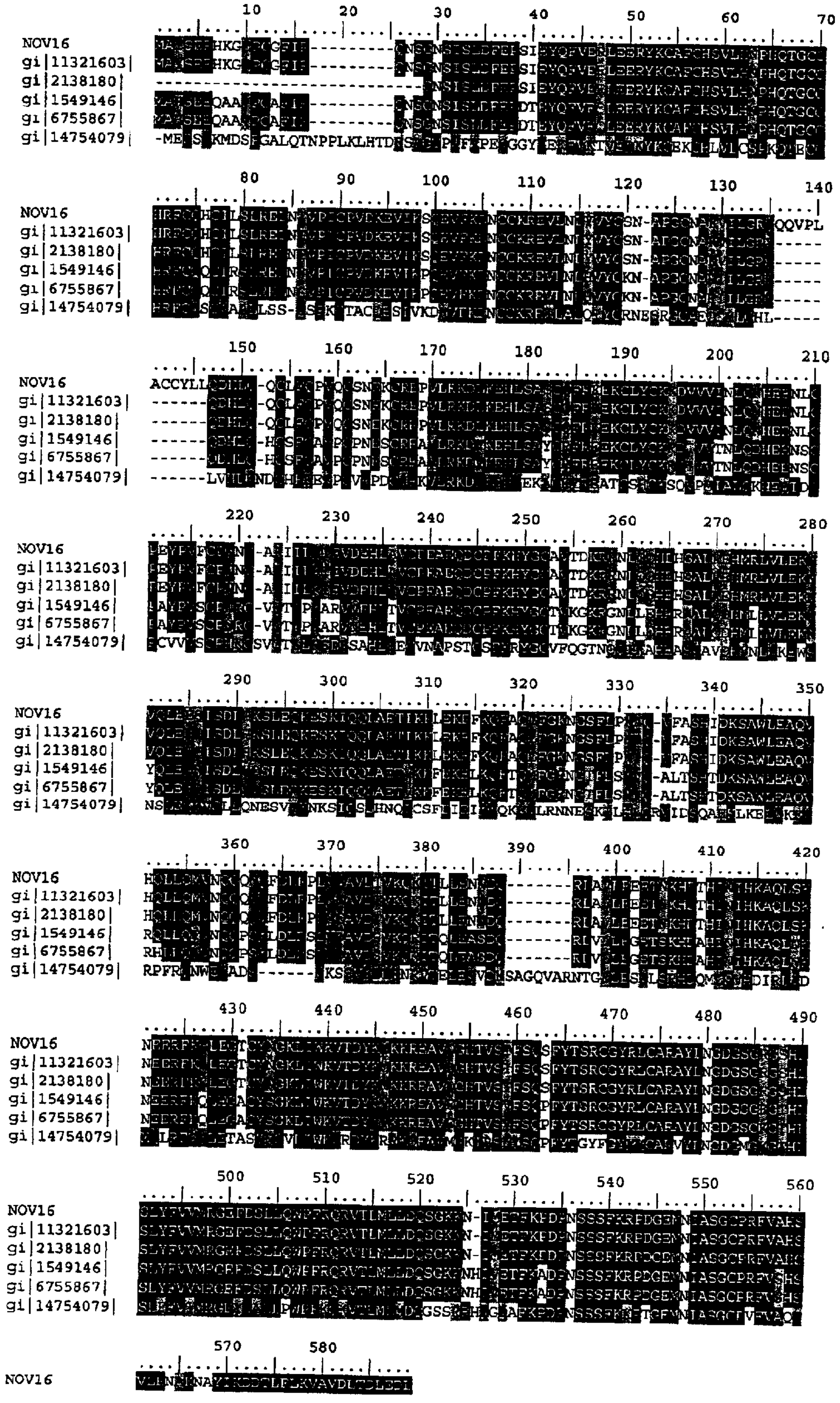

```
gi|11321603|   VLENT-NAYIKDLTLFLKVAVDLTDLEDI
gi|2138180|    VLENT-NAYIKDDTLFLKVAVDLTDLEDI
gi|1549146|    TLENS-NTYIKDDTLFLKVAVDLTDLEDI
gi|6755867|    TLENS-NTYIKDDTLFLKVAVDLTDLEDI
gi|14754079|   VLENG--TYIKDDT[illegible]F[illegible]KVIVDT[illegible]DLPDP
```

Tables 16I–16L list the domain description from DOMAIN analysis results against NOV16a. This indicates that the NOV16a sequence has properties similar to those of other proteins known to contain these domains.

TABLE 16I

Domain Analysis of NOV16a gnlPfampfam00917, MATH, MATH domain. This motif has been called the Meprin And TRAF-Homology (MATH) domain. This domain is hugely expanded in the nematode C. elegans. (SEQ ID NO:167)
Length = 116 residues, 92.2% aligned
Score = 72.8 bits (177), Expect = 5e-14

```
NOV16:  436 TVSIFSQSFYTSRCGYRLCARAYLNGDGSGRGSHLSLYFVVMRGEFDSLLQWPFRQRVTL   495
                +  |    | |     | | ||        | ||   ++|| || |+|      ||
00917:   10 EGEEYYTSPVEERFGIPWRLRIYRNGG------FLGLYLHCLKGEKDSNLKWSIEAEFTL   63

NOV16:  496 MLLDQSGKKNIMETFKPDPNSSSFKRPDGEMNIASGCPRFVAHSVLENAKNAYIKDDTLF   555
             |+  +||     | ||      |++| ||        +|++   ||   + |+ ||||
00917:   64 KLVSDNGKSL---TKKPK---HVFEKPTGEGWG-----KFISWDDLE---DDYLVDDTLI   109

NOV16:  556 LKVAVDL                                                        562
            ++  | +
00917:  110 IEAEVKI                                                        116
```

TABLE 16J

Domain Analysis of NOV16a gnlPfampfam02176, zf-TRAF, TRAF-type zinc finger. (SEQ ID NO:168)
Length = 57 residues, 100.0% alligned
Score = 58.9 bits (141), Expect = 8e-10

```
NOV16:  139 HLQQCLFQPVQCSNEKCREPVLRKDLKEHLSASCQFRKEKCLY----CKKDVVVINLQ   192
            | + | | || | | || + +||+|| +|||| |  |   | +    || |+|  |||
021765:   1 HEKTCPFVPVPCPN-KCGKKILREDLPDHLSADCPKRPVPCPFKVYGCKVDMVRENLQ    57
```

TABLE 16K

Domain Analysis of NOV16a gnlSmart|smart00061, MATH, meprin and TRAF homology (SEQ ID NO:169)
Length = 100 residues, 100.0% aligned
Score = 47.4 bits (111), Expect = 2e-06

```
NOV16:  419 WKVTDYKMKKREAVDGHTVSIFSQSFYTSRCGYRLCARAYLNGDGSGRGSHLSLYFVVMR   478
                 +|   +        | || |       +||            +   ||||    +
00061:    1 VLSHTFKNVSKF---EEGESYFSPSEEHFNIPWRLKIY--------RKNGFLSLYLHCEK    49

NOV16:  479 GEFDSLLQWPFRQRVTLMLLDQSGKKNIMETFKPDPNSSSFKRPDGEMNIASGCPRFVAH   538
             | ||  +|      || |+ |+||           ++  |++| |      |  +|++
00061:   50 EENDSR-KWSIEAEFTLKLVSQNGKS------LSKKDTHVFEKPGG-----WGFSKFISW    97

NOV16:  539 SVL                                                            541
              |
00061:   98 DDL                                                            100
```

TABLE 16L

Domain Analysis of NOV16a gnl|Smart|smart00184, RING, Ring finger; E3 ubiquitin-protein ligase activity is intrinsic to the RING domain of c-Cbl and is likely to be a general function of this domain; Various RING fingers exhibit binding activity towards E2 ubiquitin-conjugating enzymes (Ubc's) (SEQ ID NO:170)
Length = 41 residues, 97.6% aligned
Score = 38.5 bits (88), Expect = 0.001

```
NOV16:    45  CAFCHSVL-HNPHQTGCGHRFCQHCILSLRELNTVPICPV   83
              |  |      +|    ||| ||+ ||    | +    ||+
00184:     1  CPICLEEYLKDPVVLPCGHTFCRSCIRKWLESSNSNTCPI   40
```

Tumor necrosis factor (TNF; 191160) receptor-associated factors (TRAFs) are signal transducers for members of the TNF receptor superfamily (see 191190). TRAF proteins are composed of an N-terminal cysteine/histidine-rich region containing zinc RING and/or zinc finger motifs, a coiled coil (leucine zipper) motif, and a homologous region in the C terminus that defines the TRAF family, the TRAF domain. The TRAF domain is involved in self-association and receptor binding. By degenerative oligonucleotide PCR amplification, Nakano et al. (1996) identified TRAF5 in the mouse and showed that its specifically interacts with the lymphotoxin-beta receptor (600979) and activates the transcription factor NF-kappa-B (see 164011). Nakano et al. (1997) cloned the human TRAF homolog by cross hybridization with mouse TRAF5 cDNA. Their human cDNA of 2,894 bp has a 557-amino acid open reading frame that exhibits 77.5 and 80% identity to mouse TRAF5 at the nucleotide and amino acid levels, respectively. Northern blot analysis revealed that human TRAF5 mRNA is expressed in all visceral organs. Western blotting revealed that the human protein is abundantly expressed in a human follicular dendritic cell line, and to a lesser degree in several tumor cell lines. Interspecific backcross mapping showed that Traf5 is located in the distal region of mouse chromosome 1, which shares homology with human 1q. Fluorescence in situ hybridization confirmed the regional localization of human TRAF5 to chromosome 1q32. To investigate the functional role of Traf5 in vivo, Nakano et al. (1999) generated Traf5-deficient mice by gene targeting. They found that Traf5−/−B lymphocytes show defects in proliferation and upregulation of various surface molecules, including CD23 (151445), CD54 (147840), CD80 (112203), CD86 (601020), and FAS (134637) in response to CD40 (109535) stimulation. Moreover, in vitro Ig production by Traf5−/−T lymphocytes stimulated with anti-CD40 plus IL4 (147780) was reduced substantially. CD27-mediated costimulatory signal also was impaired in Traf5−/−T lymphocytes. Collectively, these results demonstrated that Traf5 is involved in CD40- and CD27-mediated signaling.

A cDNA encoding the human homolog of the tumor necrosis factor receptor-associated factor 5 (TRAF5) protein has been molecularly cloned from a cDNA library of Human Daudi B cell line. The sequence analysis revealed that the cDNA encoded a protein of 557 aa residues with a calculated molecular weight of 64,236. The encoded protein has typical structural characteristics shown in the TRAF family of proteins and binds to the cytoplasmic region of lymphotoxin-beta receptor more efficiently than to that of CD40 and CD30. The TRAF5 gene was mapped to the human chromosome 1q32.3–q41.1. Overexpression of human TRAF5 activates NF kappa B transcription factor in human 293T kidney cells. These results suggest that the human TRAF5 protein could be involved in the signal triggered by various members of the tumor necrosis factor receptor (TNFR) superfamily including CD40, CD30 and lymphotoxin-beta receptor (Mizushima S, Fujita M, Ishida T, Azuma S, Kato K, Hirai M, Otsuka M, Yamamoto T, Inoue J Cloning and characterization of a cDNA encoding the human homolog of tumor necrosis factor receptor-associated factor 5 (TRAF5). PMID: 9511754 Gene 1998 Jan. 30;207(2):135–40).

Members of tumor necrosis factor receptor (TNFR) family signal largely through interactions with death domain proteins and TRAF proteins. Here we report the identification of a novel TNFR family member ATAR. Human and mouse ATAR contain 283 and 276 amino acids, respectively, making them the shortest known members of the TNFR superfamily. The receptor is expressed mainly in spleen, thymus, bone marrow, lung, and small intestine. The intracellular domains of human and mouse ATAR share only 25% identity, yet both interact with TRAF5 and TRAF2. This TRAF interaction domain resides at the C-terminal 20 amino acids. Like most other TRAF-interacting receptors, overexpression of ATAR activates the transcription factor NF-kappaB. Co-expression of ATAR with TRAF5, but not TRAF2, results in synergistic activation of NF-kappaB, suggesting potentially different roles for TRAF2 and TRAF5 in post-receptor signaling (Hsu H, Solovyev I, Colombero A, Elliott R, Kelley M, Boyle W J ATAR, a novel tumor necrosis factor receptor family member, signals through TRAF2 and TRAF5. PMID: 9153189 J Biol Chem 1997 May 23;272(21): 13471–4).

Tumor necrosis factor (TNF) receptor-associated factors (TRAFs) are signal transducers for members of the TNF receptor superfamily. We previously identified murine TRAF5 (mTRAF5) and showed that it specifically interacts with the lymphotoxin-beta receptor (LT-beta R) and activates the transcription factor NF-kappa B. Here we have cloned the human TRAF5 homologue (hTRAF5) by cross hybridization with mTRAF5 cDNA. hTRAF5 cDNA is composed of 2894 nucleotides with a 557-amino-acid open reading frame that exhibits 77.5 and 80% identity to mTRAF5 at the nucleotide and amino acid levels, respectively. Northern blot analysis revealed that hTRAF5 mRNA is expressed in all visceral organs. Western blotting revealed that hTRAF5 protein was abundantly expressed in the human follicular dentritic cell line, FDC-1, and to a much lesser degree in several tumor cell lines. Interspecific backcross mapping revealed that Traf5 is located in the distal region of mouse chromosome 1, which shares a region of homology with human chromosome 1q. Fluorescence in situ hybridization confirmed regional localization to human chromosome 1q32 (Nakano H, Shindo M, Yamada K, Yoshida M C, Santee S M, Ware C F, Jenkins N A, Gilbert D J, Yagita H, Copeland N C, Okumura K Human TNF receptor-associated factor 5 (TRAF5): cDNA cloning, expression and assignment of the TRAF5 gene to chromosome 1q32. PMID: 9177772 Genomics 1997 May 15;42(1):26–32).

The above defined information for NOV16 suggests that this NOV16 protein may function as a member of a TNFR protein family. Therefore, the NOV16 nucleic acids and proteins of the invention are useful in potential therapeutic and diagnostic applications. For example, a cDNA encoding the NOV16 protein may be useful in gene therapy, and the NOV16 protein may be useful when administered to a subject in need thereof. By way of nonlimiting example, the compositions of the present invention will have efficacy for treatment of patients suffering from diseases or disorders involving signal transduction and members of the TNF receptor superfamily, as well as, CR1 deficiency; Cardiomyopathy, familial hypertrophic, 2; Cardiomyopathy, familial, dilated-2; Ectodermal dysplasia/skin fragility syndrome; Epidermolysis bullosa, Herlitz junctional type; Epidermolysis bullosa, generalized atrophic benign; Factor H deficiency; Glomerulopathy, fibronectin; Hemolytic-uremic syndrome; Hemolytic-uremic syndrome; Membroproliferative glomerulonephritis; Nephropathy, chronic hypocomplementemic; Popliteal pterygium syndrome; Severe combined immunodeficiency due to PTPRC deficiency; Chitotriosidase deficiency; Hyperproreninemia; van der Woude syndrome; SLE susceptibility; Malignant hyperthermia susceptibility 5; Measles, susceptibility to; Multiple sclerosis, susceptibility to; AIDS, cancer, immunological disorders and diseases; viral and bacterial susceptibility and immunity and/or septic shock. The NOV16 nucleic acid encoding TNFR-like protein, and the TNFR-like protein of the invention, or fragments thereof, may further be useful in diagnostic applications, wherein the presence or amount of the nucleic acid or the protein are to be assessed.

NOV17

A disclosed NOV17 nucleic acid of 622 nucleotides (designated CuraGen Acc. No. CG56101-01) encoding a novel Ferritin light chain-like protein is shown in Table 17A. An open reading frame was identified beginning with an ATG initiation codon at nucleotides 18–20 and ending with a TAG codon at nucleotides 603–605. Putative untranslated regions upstream from the initiation codon and downstream from the termination codon are underlined in Table 17A, and the start and stop codons are in bold letters.

TABLE 17A

| NOV17 Nucleodide Sequence |
| --- |
| (SEQ ID NO:39) |
| CTCCTTTCCAAAGAACC**ATG**AGTTCCCACATCAGCCAGAATTACTGCACCGAAGTGGAAGCCGCCGTCAGCAGCCTGGT |
| CCACCGGCAGCTGCGGGCTTCCCTTACCTACCTCTCTCTCATCCTCCATTTCTACCGCGACGACGTGACCCTGGAGGGC |
| ATGGGCCACTTCCGAGAGCTGGCCCAGGAGAAGCGACAGGGCGCCCAGAGTCTGTGGAAGACGCAAAACCAGCGCGGAG |
| CCCTCTGCGATGCCATCCAGAAGCCGTCCTGGGATGAAAAGGACAGCAGTTTGGGCGCCCTGCGAGCCGCGTTGGCCCT |
| GGAGACGAACCTGAACCAGGCCCTGCTGGATCTGCACGCCCTGGGCGCAAAGCATGCAGACTCTCACCCCTGCGGCTTC |
| CTGGAGAACCACTTCCGGCCACATCCCTCTGTCAGACCTGGGAAAGCGTCCACCCGAGCTGCTCCCTTCAACCTCAAGA |
| TACATTTTTTTTCTTTCTTTCTTTTTGAAAGAGTCTCCCTGCGTGTAGACCCCTGGACTATTGATTGCACCACATTCAT |
| TCCTTCCCCAGCTCACTACTCCAACAAGGTACCAAATATACCAAATATT**TAG**AGAATTAGGATGAACTA |

The nucleic acid sequence of NOV17 maps to chromosome 4 and has 191 of 246 bases (77%) identical to a *Oryctolagus cuniculus* ferritin light chain subunit mRNA (gb:GENBANK-ID:OCFERL|acc:X07830.1) (E=6.2e$^{-25}$).

A NOV17 polypeptide (SEQ ID NO:40) encoded by SEQ ID NO:39 is 201 amino acid residues and is presented using the one letter code in Table 17B. Signal P, Psort and/or Hydropathy results predict that NOV17 does not contain a signal peptide and is likely to be localized in the cytoplasm with a certainty of 0.4500.

TABLE 17B

| NOV17 protein sequence |
| --- |
| (SEQ ID NO:40) |
| MSSHISQNYCTEVEAAVSSLVHRQLRASLTYLSLILHFYRDDVTLEGMGHFRELAQEKRQGAQSLWKTQNQRGALCDAIQKPS |
| WDEKDSSLGALRAALALETNLNQALLDLHALGAKHADSHPCGFLENHFRPHPSVRPGKASTRAAPFNLKIHFFSFFLFERVSL |
| RVDPWTIDCTTGIPSPAHYSNKVPNIPNIXRIRMN |

The NOV17 amino acid sequence has 95 of 175 amino acid residues (54%) identical to, and 113 of 175 amino acid residues (64%) similar to, a *Oryctolagus cuniculus* 175 amino acid residue ferritin light chain protein (ptnr:pir-id:S01239) (E=1.8e$^{-37}$).

NOV17 is expressed in at least the following tissues: colon tumor. This information was derived by determining the tissue sources of the sequences that were included in the invention including but not limited to SeqCalling sources, Public EST sources, Literature sources, and/or RACE sources and the expression pattern of a closely related Oryctolagus cuniculus ferritin light chain subunit mRNA homolog (gb:GENBANK-ID:OCFERL|acc:X07830.1)

NOV17 also has homology to the amino acid sequences shown in the BLASTP data listed in Table 17C.

TABLE 17C

BLAST results for NOV17

| Gene Index/ Identifier | Protein/Organism | Length (aa) | Identity (%) | Positives (%) | Expect |
|---|---|---|---|---|---|
| gi\|6016050\|sp\| O46415\|FRIL_BOVIN | FERRITIN LIGHT CHAIN (FERRITIN L SUBUNIT) [*Bos taurus*] | 175 | 82/134 (61%) | 92/134 (68%) | 2e−35 |
| gi\|7739645\|gb\| AAF68948.1\|AF230928_1 (AF230928) | ferritin light chain [*Cavia porcellus*] | 175 | 81/134 (60%) | 94/134 (69%) | 6e−35 |
| gi\|204131\|gb\| AAA41154.1\| (K01930) | ferritin light chain subunit [*Rattus norvegicus*] | 183 | 81/134 (60%) | 93/134 (68%) | 2e−34 |
| gi\|1169741\|sp\| P02791\|FRIL_HORSE | FERRITIN LIGHT CHAIN (FERRITIN L SUBUNIT) [*Equus caballus*] | 175 | 81/134 (60%) | 94/134 (69%) | 2e−34 |
| gi\|6679873\|ref\|NP_ 032075.1\| (NM_008049) | ferritin light chain 2 [*Mus musculus*] | 183 | 80/134 (59%) | 92/134 (67%) | 5e−34 |

The homology of these sequences is shown graphically in the ClustalW analysis shown in Table 17D.

Table 17D ClustalW Analysis of NOV17

1) NOV17 (SEQ ID NO:40)

2) gi 6016050|sp O46415 FRIL_BOVIN FERRITIN LIGHT CHAIN (FERRITIN L SUBUNIT) [Bos taurus] (SEQ ID NO:171)

3) gi 7739645|gb AAF68948.1 AF230928_1 (AF230928) ferritin light chain [Cavia porcellus] (SEQ ID NO:172)

4) gi 204131|gb AAA41154.1| (K01930) ferritin light chain subunit [Rattus norvegicus] (SEQ ID NO:173)

5) gi 1169741|sp P02791 FRIL_HORSE FERRITIN LIGHT CHAIN (FERRITIN L SUBUNIT) [Equus caballus] (SEQ ID NO:174)

6) gi 6679873|ref NP_032075.1| (NM_008049) ferritin light chain 2 [Mus musculus] (SEQ ID NO:175)

```
                    10        20        30        40        50        60        70
            ....|....|....|....|....|....|....|....|....|....|....|....|....|....|
NOV17       MSSHFSRNYCTEVEAAVSSLVHRQLRASLTYLSLILGHYRDDVTLEGCGH-FRELAEEKRQGAESSLWRTQ
gi|6016050| MSSQIRQNYSTEVEAAVNRLVNLQLRASYTYLSLGFFFDRDDVALEGVCHFFRELAEEKREGAERLLKMQ
gi|7739645| MSSQIRQNYSTEVEAAVNRLVNLHLEASYTYLSLGFFFDRDDVALAGVCHFFRELAEEKREGAERLLKMQ
gi|204131|  MSSQIRQNYSTEVEAAVNRLVNLHLRASYTYLSLGFFFDRDDVALEGVGHFFRELAEEKREGAERLLKMQ
gi|1169741| MSSQIRQNYSTEVEAAVNRLVNLHLRASYTYLSLGFFFDRDDVALEGVCHFFRELAEEKREGAERLLKMQ
gi|6679873| MSSQIRQNYSTEVEAAVNRLVNLHLRASYTYLSLGFFFDRDDVALEGVGHFFRELAEEKREGAERLLKMQ

                    80        90        100       110       120       130       140
            ....|....|....|....|....|....|....|....|....|....|....|....|....|....|
NOV17       NQRG--ALCDAQKPSWDEKDSGLGAMEAALALEKTLNQALLDLHALGSKHADSHPCGFLESHFRPHPSV
gi|6016050| NQRGGRALFLDVQKPSQDEWGKTQDAMEAALLLEKNLNQALLDLHGLASARGDPHLCDFLESHFLDEEVK
gi|7739645| NQRGGRALFQDVQKPSQDEWGKTLEAMEAALTLEKSLNQALLDLHALGSARTDSHLCDFLENHFLDEEVK
gi|204131|  NQRGGRALFQDVQKPSQDEWGKTLEAMEAALALEKNLNQALLDLHALGSARADPHLCDFLESHFLDKEVK
gi|1169741| NQRGGRALFQDVQKPSQDEWGKTTPAMEAAIVLEKSLNQALLDLHALGSAQADPHLCDFLESHFLDEEVK
gi|6679873| NERGGRALFQDVQKPSQDEWGKTLEAMEAALRLEKNLNQALLDLHALGSARTDPHLCDFLESHFLDKEVK

                    150       160       170       180       190       200       210
            ....|....|....|....|....|....|....|....|....|....|....|....|....|....|
NOV17       RPGQASTRAAQFN-QKIHF----------FSFQLFERLSLKVDPWTIDCTTFIPSPAHYSNKVPNIPNIX
gi|6016050| LIKKMGDHLTNLRRLAG---------PQAGLGEYLFERLTLKHD--------------------------
gi|7739645| LIKKMGDHLTNLRRLDG---------PQAGLGEYLFERLTLKHD--------------------------
gi|204131|  LIKKMGNHLTNLRRWQG-QPAQTGVAQASLGEYLFERLTLKHD--------------------------
gi|1169741| LIKKMGDHLTNLRRLVGS--------QAGLGEYLFERLTLKHD--------------------------
gi|6679873| LIKKMGNHLTNLRRVAGPQPVQTGVAQASLGEYLFERLTLKHD--------------------------

            ....|
NOV17       RIRMN
```

| | |
|---|---|
| gi\|6016050\| | ----- |
| gi\|7739645\| | ----- |
| gi\|204131\| | ----- |
| gi\|1169741\| | ----- |
| gi\|6679873\| | ----- |

Table 17E lists the domain description from DOMAIN analysis results against NOV17. This indicates that the NOV17 sequence has properties similar to those of other proteins known to contain these domains.

TABLE 17E

Domain Analysis of NOV17

```
gnl|Pfam|pfam00210, ferritin, Ferritin. (SEQ ID NO:176)
Length = 155 residues, 78.1% aligned
Score = 104 bits (260), Expect = 4e-24
NOV17:   14 EAAVSSLVHRQLRASLTYLSLILHFYRDDVTLEGMGHF-RELAQEKRQGAQSLWKTQNQR   72
            |||++  ++ +| ||  |||+  +| |||| | |   | || + |+|+ |+ | | ||+|
00210:    2 EAALNRQINLELYASYVYLSMAAYFDRDDVALPGFAKFFREASHEEREHAEKLMKYQNKR   61

NOV17:   73 GALCD--AIQKPSWDEKDSSLGALRAALALETNLNQALLDLHALGAKHADSHPCGFLENH  130
            |       |+||  ||  | | |++ || || ++||+||+|| +   + | | | |||+
00210:   62 GGRVVLQDIKKPEKDEWGSGLEAMQTALQLEKSVNQSLLELHKVATDNNDPHLCDFLESE  121

NOV17:  131 F                                                             131
            +
00210:  122 Y                                                             122
```

Ferritin is one of the major non-heme iron storage proteins. It consists of a mineral core of hydrated ferric oxide, and a multi-subunit protein shell which englobes the former and assures its solubility in an aqueous environment.

In animals the protein is mainly cytoplasmic and there are generally two or more genes that encodes for closely related subunits (in mammals there are two subunits which are known as H(eavy) and L(ight)). In plants ferritin is found in the chloroplast.

There are a number of well conserved region in the sequence of ferritins. We have selected two of these regions to develop signature patterns. The first pattern is located in the central part of the sequence of ferritin and it contains three conserved glutamate which are thought to be involved in the binding of iron. The second pattern is located in the C-terminal section, it corresponds to a region which forms a hydrophilic channel through which small molecules and ions can gain access to the central cavity of the molecule; this pattern also includes conserved acidic residues which are potential metal binding sites.

Ferritin is the major intracellular iron storage protein in all organisms. It has the shape of a hollow sphere that permits entry of a variable amount of iron for storage as ferric hydroxide phosphate complexes. Mammalian liver and spleen ferritin (relative mass about 450,000) consists of 24 subunits of 2 species, the heavy subunit (relative mass=21,000) and the light subunit (relative mass=19,000). Brown et al. (1983) presented evidence that, in the rat, the 2 species of subunits are coded by separate mRNAs. Furthermore, a family of genes appear to encode the light subunit. Studies of ferritin synthesis in cell-free systems suggested that the H and L subunits have different mRNA molecules (Watanabe and Drysdale, 1981). By study of human/Chinese hamster hybrid cells and use of a radioimmunoassay specific for human ferritin, Caskey et al. (1983) showed that chromosome 19 encodes the structural gene for ferritin. Thus, mutation in the structural gene for ferritin is not responsible for hemochromatosis, since that disorder is coded by chromosome 6. By in situ hybridization, McGill et al. (1984) confirmed the assignment of the light chain gene to chromosome 19 but concluded that the heavy chain is encoded by 1p. By study of hamster-human and mouse-human hybrid cells, some with translocations involving chromosome 19, Worwood et al. (1985) concluded that light subunits of ferritin (rich in human spleen ferritin) are coded by a gene in segment 19q13.3-qter and that the gene for the heavy subunit (rich in human heart ferritin) is located on chromosome 11. By miniaturized restriction enzyme analysis of sorted chromosomes, Lebo et al. (1985) demonstrated ferritin light-chain genes on at least 3 chromosomes. Munro et al. (1988) reviewed information on the ferritin genes. They pointed out that in both the rat and the human, several ferritin pseudogenes can be recognized not only because they are flanked by 5-prime and 3-prime direct repeats representing the site of their retroinsertion into the chromatin, but also because they differ from functional genes by the absence of introns and by the presence of polyadenylic acid tails that have been inserted onto the 3-prime end of the messenger transcription of the functional gene. They cited the evidence of Santoro et al. (1986) and of Hentze et al. (1986) that there is only one expressed H and one expressed L gene in the human genome.

The above defined information for NOV17 suggests that this NOV17 protein may function as a member of a Ferritin light chain protein family. Therefore, the NOV17 nucleic acids and proteins of the invention are useful in potential therapeutic and diagnostic applications. For example, a cDNA encoding the NOV17 protein may be useful in gene therapy, and the NOV17 protein may be useful when administered to a subject in need thereof. By way of nonlimiting example, the compositions of the present invention will have efficacy for treatment of patients suffering from hyperferritinemia and cataract and/or Cancer. The NOV17 nucleic acid encoding Ferritin light chain-like protein, and the Ferritin light chain-like protein of the invention, or fragments thereof, may further be useful in diagnostic applications, wherein the presence or amount of the nucleic acid or the protein are to be assessed.

NOV18

A disclosed NOV18 nucleic acid of 781 nucleotides (designated CuraGen Acc. No. CG56095-01) encoding a novel Neurotrophin-6 alpha-like protein is shown in Table 18A. An open reading frame was identified beginning with an AGC codon at nucleotides 67–69 and ending with a TGA codon at nucleotides 778–780. Putative untranslated regions upstream from the initiation codon and downstream from the termination codon are underlined in Table 18A, and the start and stop codons are in bold letters.

TABLE 18A

| NOV18 Nucleotide Sequence |
|---|
| (SEQ ID NO:41) |
| ATTTACTATTAATCTACAAGTTGGGTGTTATGCAAGTCCTATATATGGAGTCCCCCAAACTTCTAG**AGC**AAGGGCTTCC |
| CCATAATCCTGGCAGGCAGGCCTCCCCTGGGGTTCCCAACTTCTGACCCCACTGAAGTGTTTATCCTCTTCTCTAATCC |
| CAGCCTCCTTTTCCCTGTCTCCATGTGCTCTGAGAGGTGCTCTGAGAGATGCTCCCGCTCCCCCAGACTCCCTCTACAT |
| CCCCCTCATTTTCTTCCTCTCCAGTGTGTCAATGGGGTCCTAACCCCACCCTCGACATTGTCGCCTTTTCCTGATCCAA |
| AGTGGGACCTTCTTTTCCCCCGAGTGGTCCTGCCTAGGGGTGCCGCTGCCGGGCCCCCTCTGGTCTTCCTGCTGGAGAC |
| TGGGGCCTTTCGGGAGTCAGCAGGCGCCCGGGCCAACCGCAGCCAGCGAGGGGTGAGCAATACTTCACTGGCGAGTCAT |
| CAGGGTGAGCTGGCCGTGTGTGATGCAGTCACTGGCTGGGTGACAGACCCCCGGACCGCTGTGGACTCAGGTGTGCTGG |
| AGGTGGAGGTGTTGGGCGAGGTGCCTGCAGCTGGCGGCAGTTCCCTCTGCCAACACTTCTTTGTCACCTGCTTCGAGGC |
| CAATAACTCTGAAGAAGGTGGCCCAGCGGTAGGTGGAGGGGCTGCCGCAGGGGTGTGGACCGGGGGGCACTGGGTGTCT |
| GAGTGCAAGGCCAAGCAGTCCTATGTGCGGGCATTGACCGCTGATGCCCAGGGCTGTGTGGACTGG**TGA**T |

The nucleic acid sequence of NOV18 maps to chromosome 19 and has 740 of 781 bases (94%) identical to a *Homo sapiens* NT6-alpha-acidic neurotrophin 6 alpha mRNA (gb:GENBANK-ID:S41522|acc:S41522.1) (E=8.6e$^{-154}$).

A NOV18 polypeptide (SEQ ID NO:42) encoded by SEQ ID NO:41 is 237 amino acid residues and is presented using the one letter code in Table 18B.

TABLE 18B

| NOV18 protein sequence |
|---|
| (SEQ ID NO:42) |
| SKGFPIILAGRPPLGFPTSDPTEVFILFSNPSLLFPVSMCSERCSERCSRSPRLPLHPPHFLPLQCVNGVLTPPSTLSPFPDP |
| KWDLLFPRVVLPRGAAAGPPLVFLLETGAFRESAGARANRSQRGVSNTSLASHQGELAVCDAVTGWVTDPRTAVDSGVLEVEV |
| LGEVPAAGGSSLCQHFFVTCFEANNSEEGGPGVGGGAAAGVWTGGHWVSECKAKQSYVRALTADAQGCVDW |

The NOV18 amino acid sequence has 215 of 237 amino acid residues (90%) identical to, and 220 of 237 amino acid residues (92%) similar to, a *Homo sapiens* 257 amino acid residue neurotrophin-6 alpha protein (NT-6 alpha) (ptnr:SWISSPROT-ACC:P34132) (E=3.1e$^{-113}$).

NOV18 is expressed in at least the following tissues: Placenta, Uterus and Whole Organism. This information was derived by determining the tissue sources of the sequences that were included in the invention including but not limited to SeqCalling sources, Public EST sources, Literature sources, and/or RACE sources and because of the expression pattern of a closely related Homo sapiens NT6-alpha-acidic neurotrophin 6 alpha mRNA homolog (gb:GENBANK-ID:S41522|acc:S41522.1).

Possible small nucleotide polymorphisms (SNPs) found for NOV18 are listed in Table 18C.

TABLE 18C

| SNPs | | | | |
|---|---|---|---|---|
| Variant | Nucleotide Position | Base Change | Amino Acid Position | Base Change |
| 13376701 | 314 | C > T | 83 | Pro > Leu |
| 13375249 | 322 | G > A | 86 | Asp > Asn |
| 13376702 | 377 | T > C | 104 | Leu > Pro |

NOV18 also has homology to the amino acid sequences shown in the BLASTP data listed in Table 18D.

TABLE 18D

BLAST results for NOV18

| Gene Index/ Identifier | Protein/Organism | Length (aa) | Identity (%) | Positives (%) | Expect |
|---|---|---|---|---|---|
| gi\|462743\|sp\| P34132\|NT6A_HUMAN | NEUROTROPHIN-6 ALPHA (NT-6 ALPHA) [*Homo sapiens*] | 257 | 160/237 (67%) | 165/237 (69%) | 1e−74 |
| gi\|462744\|sp\| P34133\|NT6B_HUMAN | NEUROTROPHIN-6 BETA (NT-6 BETA) [*Homo sapiens*] | 257 | 155/237 (65%) | 159/237 (66%) | 4e−71 |
| gi\|17482866\|ref\|XP_ 064951.1\| (XM_064951) | similar to NEUROTROPHIN-6 BETA (NT-6 BETA) [*Homo sapiens*] | 210 | 116/172 (67%) | 120/172 (69%) | 2e−52 |
| gi\|462745\|sp\| P34134\|NT6G_HUMAN | NEUROTROPHIN-6 GAMMA (NT-6 GAMMA) [*Homo sapiens*] | 186 | 112/165 (67%) | 119/165 (71%) | 4e−49 |
| gi\|5453808\|ref\|NP_ 006170.1\| (NM_006179) | neurotrophin 5 preproprotein; neurotrophic factor 5; neurotrophin 4; neurotrophic factor 4 [*Homo sapiens*] | 210 | 99/165 (60%) | 109/165 (66%) | 9e−40 |

The homology of these sequences is shown graphically in the ClustalW analysis shown in Table 18E.

Table 18E ClustalW Analysis of NOV18

1) NOV18 (SEQ ID NO:42)
2) gi 462743|sp P34132 NT6A_HUMAN NEUROTROPHIN-6 ALPHA (NT-6 ALPHA) [Homo sapiens] (SEQ ID NO:177)
3) gi 462744|sp P34133 NT6B_HUMAN NEUROTROPHIN-6 BETA (NT-6 BETA) [Homo sapiens] (SEQ ID NO:178)
4) gi 17482866|ref XP_064951.1| (XM_064951) similar to NEUROTROPHIN-6 BETA (NT-6 BETA) [Homo sapiens] (SEQ ID NO:179)
5) gi 462745|sp P34134 NT6G_HUMAN NEUROTROPHIN-6 GAMMA (NT-6 GAMMA) [Homo sapiens] (SEQ ID NO:180)
6) gi 5453808|ref NP_006170.1| (NM_006179) neurotrophin 5 preproprotein; neurotrophic factor 5; neurotrophin 4; neurotrophic factor 4 [Homo sapiens] (SEQ ID NO:181)

```
                    10        20        30        40        50        60        70
            ....|....|....|....|....|....|....|....|....|....|....|....|....|....|
NOV18       SKGFPIILAGRPPLGFPTSDPTEVFILFSNPSLLFFVSMCSERCSERCSRSFRLFLHPFHFLFLQCVNGV
gi|462743|  SKGFPIILAGRPPLGFPTSDPTEVFILFSNPSLLFFVSVCSERCSERCSHSFRLFPHPFHFFFPQCVNGV
gi|462744|  SKGFPIILAGRPPLGFPTSDPTEVFIFFPNPSLLFFVSMCSERCSERCSCSFMLFPHPSHFFFPQCVIGV
```

```
gi|17482866|  ------------------------------MLKL-----------------PCAFSASFSFSSSPGNIGN
gi|462745|    ----------------------------------------------------------------------
gi|5453808|   ------------------------------MLPLL---------------SCSLLILLLFLLLSVPLE-S

                       80        90       100       110       120       130       140
              ....|....|....|....|....|....|....|....|....|....|....|....|....|....|
NOV18         LTPPSTLSFFPDIEWDLLPFRVVLPRGAAAGPPLVFLLETGAFRESAGARANRSQRGVSETSLASHQGEI
gi|462743|    LTFSSTLSFFPPPEWDLLPFRVVLSRGAAAGPPLVFLLETGAFRESAGARANRSQRGVSDTSPASHQGEI
gi|462744|    LTFSSTLSRFPPPEWDLLPPRVVLSRGAAAGPPLVFLLETGAFRESAGARANRSQRGVSDTSPVSHQGEI
gi|17482866|  LTFSSTLSRFPPPEWDLLTPRVVLSRGAAAGPPLVFLLETGAFRESAGARANRSQRGVSDTSHVSHQGEI
gi|462745|    -PLPLTLSTFPPIEWDLLPFRVVLSRGAAAGIPLVFLLETGAFWESAGTRANRSQRGVSDTSPASHQGEI
gi|5453808|   QPLPSILPPSLAPEWDLISPRVVLSRGAPAGPPLVFLLEAGAFRESAGAPPNRSQRGVSETEPASRQGEI

                      150       160       170       180       190       200       210
              ....|....|....|....|....|....|....|....|....|....|....|....|....|....|
NOV18         AVCDAVSGAVTIRRIAVDSGVLEVEVLGEVPAAVGSSLCQHFFVTCFEADNSEEGGPGVGGGAAAGVWTI
gi|462743|    AVCDAVSVAVIIPWTAVDLGVLEVEVLGEVPAAVGSSLRQHFFVARFEADKSEEGGPGVGGGAAAGVWTQ
gi|462744|    AVCDAVSVAVIIPWTAVDLGVLEVEVLCEVPAASSSSLRQHFFVTRFEADKSEEGGPGVGGSPAAGVWTQ
gi|17482866|  AVCDAVSVAVIIPWTAVDLGVLEVEVLCEVPAASSSSLRQHFFVTRFEADKSEEGGPGVGGGPAAGVWTQ
gi|462745|    AVCDAVSVAVTEFRTAVDLVVLEVEVLCLVPAACSSSLHQHFFVTCFEADNSEEGGPGVGGGAAAGVWTQ
gi|5453808|   AVCDAVSGAVTIRRTAVDLRGR-VEVLCEVPAACGSPLRQHFFETIRCSADNSEEGGPGAGGGCRGVDRR

                      220       230       240       250
              ....|....|....|....|....|....|....|....|....|..
NOV18         GHWVSEDKAKQSYVFALTPDAQGCVDA--------------------
gi|462743|    GHWVSEDKAKQSYVFALTADAQGRVDWRWIQIGTACVCTLLSRTGRA
gi|462744|    GHWVSEDKANQSYGRALTTDAQGRVDWRWIQIGTACVCTLLSRTGRA
gi|17482866|  GHWVSEDKAKQSYGFALTTPAQGRVDWRWIQIGTACVCTLLSRTGRA
gi|462745|    GHWVSEDKANQSYVFALTADAQGRVDWRWIQTGTACVCTLLSRTGRA
gi|5453808|   -HWVSEDKAKQSYVFALTADAQGRVGWRWIQIDTACVCTLLSRTGRA
```

Tables 18F and 18G list the domain description from DOMAIN analysis results against NOV18. This indicates that the NOV18 sequence has properties similar to those of other proteins known to contain these domains.

TABLE 18F

Domain Analysis of NOV18

```
gnl|Pfam|pfam00243, NGF, Nerve growth factor family. (SEQ ID NO:182)
Length = 117 residues, 81.2 % aligned
Score = 70.9 bits (172), Expect = 8e-14
NOV18:  134 ASHQGELAVCDAVTGWVTDPRTAVDSGVLEVEVLGEVPAAGGSSLCQHFFVT-CFEANNS  192
            || +|||+|||+|+ ||||  ||||    +  +           | |+|| | |
00243:    3 ASRRGELSVCDSVSVWVTDKTTAVD-IRGKEVTVLGEVNTNNGPLKQYFFETKCKPPGPV  61

NOV18:  193 EEGGPGVGGGAAAGVWTGGHWVSECKAKQSYVRALTADAQGCVDW                237
                               || ||||  |+|||||| ||   | |
00243:   62 GS---------GCRGIDKRHWNSECKTTQTYVRALTMDANKRVGW                97
```

TABLE 18G

Domain Analysis of NOV18

```
gnl|Smart smart00140, NGF, Nerve growth factor (NGF or beta-NGF); NGF
is important for the development and maintenance of the sympathetic
and sensory nervous systems. (SEQ ID NO:183)
Length = 106 residues, 88.7 % aligned
Score = 68.2 bits (165), Expect = 5e-13
NOV18:  135 SHQGELAVCDAVTGWVTDPRTAVDSGVLEVEVLGEVPAAGGSSLCQHFFVT-CFEANNSE  193
            ||+|| +|||+|| ||||  || |    +   +          | |+|| | |   |  +
00140:    1 SHRGEYSVCDSVSVWVTDKTTATD-ISGKEVTVLGEVPVNNGPLKQYFFETRCKSPNPVK  59

NOV18:  194 EGGPGVGGGAAAGVWTGGHWVSECKAKQSYVRALTADAQGCVDW                 237
                              || | |   |+||||||+||   | |
00140:   60 S---------GCRGIDSRHWNSHCTTTQTYVRALTSDANQRVGW                 94
```

The neurotrophins, a family of mammalian neuronal survival and differentiation factors, are basic proteins that are proteolytically cleaved at a dibasic cleavage site to yield a mature protein with 6 invariant cysteine residues. Berkemeier et al. identified human genomic clones corresponding to neurotrophin-5 (NT5; and 3 related genes that they designated NT6-alpha, -beta, and -gamma They also isolated a partial NT6-alpha cDNA. The NTF6-alpha open reading frame encodes a predicted 255-amino acid protein that lacks an initiation codon. Although the NT6-alpha DNA sequence is more than 90% identical to that of NT5, homology between the 2 proteins begins at amino acid 74 of NT6-alpha because the 2 proteins utilize different reading frames. The C-terminal putative mature half of NT6-alpha shares 75% and 45% identity to those of NT5 and nerve growth factor respectively. Berkemeier et al. (1992) suggested that NT6-alpha may be a pseudogene because they were unable to identify an initiation codon, and because the deduced protein is acidic and lacks the dibasic cleavage site and 2 of the 6 conserved cysteines that are characteristic of neurotrophins. Independently, Ip et al. (1992) cloned genomic segments of the same gene, which they considered to be an NT4 pseudogene. By analysis of somatic cell hybrids, Berkemeier et al. (1992) mapped the NT5 and NT6 genes to human chromosome 19. Using Southern blot analysis, they determined that NT6-related genes are present in monkey and cow, but not in rodents. By FISH, Ip et al. (1992) mapped both the NT4 and the NT4 pseudogene to 19q13.3, suggesting that the pseudogene arose via a gene duplication event.

The above defined information for NOV18 suggests that this NOV18 protein may function as a member of a Neurotrophin-6 alpha protein family. Therefore, the NOV18 nucleic acids and proteins of the invention are useful in potential therapeutic and diagnostic applications. For example, a cDNA encoding the NOV18 protein may be useful in gene therapy, and the NOV18 protein may be useful when administered to a subject in need thereof. By way of nonlimiting example, the compositions of the present invention will have efficacy for treatment of patients suffering from Fertility, Endometriosis, bone metabolism disorder; proinflammatory disorder; immune disorder; inflammatory disease; septic shock; stroke; diabetes; arthritis; intercolitis; pneumonitis; epithelial cell; skin disease; proliferative disorder; skin cancer; melanoma; Kaposi's sarcoma; epithelial cancer; squamous cell carcinoma; bone resorption disorder; osteoporosis; Paget's disease; osteoarthritis; degenerative arthritis; osteogenesis imperfecta; fibrous displasia; hypophosphatasia; bone sarcoma; myeloma bone disorder; osteolytic bone lesion; hypercalcemia; bone mass; bone fragility; bone pain; bone deformity and/or bone fracture. The NOV18 nucleic acid encoding Neurotrophin-6 alpha-like protein, and the Neurotrophin-6 alpha-like protein of the invention, or fragments thereof, may further be useful in diagnostic applications, wherein the presence or amount of the nucleic acid or the protein are to be assessed.

NOV19

NOV19 includes three novel Methionin Aminopeptidase-like proteins disclosed below. The disclosed proteins have been named NOV19a, NOV19b and NOV19c.

NOV19a

A disclosed NOV19a nucleic acid of 1018 nucleotides (designated CuraGen Acc. No. CG50287-02) encoding a novel Methionin Aminopeptidase-like protein is shown in Table 19A. An open reading frame was identified beginning with an TCA codon at nucleotides 56–58 and ending with a TGA codon at nucleotides 1001–1003. A putative untranslated region downstream from the termination codon is underlined in Table 19A, and the start and stop codons are in bold letters.

TABLE 19A

| NOV19a Nucleotide Sequence |
|---|
| (SEQ ID NO:43) |
| GGCGCCCAGCGGCTTGCACCTGTTCGTCCGAAGAGGTTGTCATAGGATTTTCTGA**TCA**CCACTCAATCATATCTACTTA |
| CACAAGCAGTCAAGCAGTCAACAAAGAAGAAATTTCTTTTTTCGGAGACAAAGAGATATTTCACACAGTATAGTTTTGC |
| CGGCTGCAGTTTCTTCAGCTCATCCGGTTCCTAAGCACATAAAGAAGCCAGACTATGTGACGACAGGCATTGTACCAGA |
| CTGGGGAGACAGCATAGAAGTTAAGAATGAAGATCAGATTCAAGGGCTTCATCAGGCTTGTCAGCTGGCCCGCCACGTC |
| CTCCTCTTGGCTGGGAAGAGTTTAAAGGTTGACATGACAACTGAAGAGATAGATGCTCTTGTTCATCGGGAAATCATCA |
| GTCATAATGCCTATCCCTCACCTCTAGGCTATGGAGGTTTTCCAAAATCTGTTTGTACCTCTGTAAACAACGTGCTCTG |
| TCATGGTATTCCTGACAGTCGACCTCTTCAGGATGGAGATATTATCAACATTGATGTCACAGTCTATTACAATGGCTAC |
| CATGGAGACACCTCTGAAACATTTTTGGTGGGCAATGTGGACGAATGTGGTAAAAAGTTAGTGGAGGTTGCCAGGAGGT |
| GTAGAGATGAAGCAATTGCAGCTTGCAGAGCAGGGGCTCCCTTCTCTGTAATTGGAAACACAATCAGCCACATAACTCA |
| TCAGAATGGTTTTCAAGTCTGTCCACATTTTGTGGGACATGGAATAGGATCTTACTTTCATGGACATCCAGAAATTTGG |
| CATCATGCAAACGACAGTGCATCTACCCATGGAGGACCGCATGGCATTCACTATAGAGCCAATCATCACGGAGGCGATCCC |
| CTGAATTTAAAGTCCTGGAGGATGCATGGACTGTGGTCTCCCTAGACAATCAAAGGTCGGCGCAGTTCGAGCACACGGT |
| TCTGATCACGTCGAGGGGCGCGCAGATCCTGACCAAACTACCCCATGAGGCC**TGA**GGAGCCGCCCGAAGG |

The nucleic acid sequence of NOV19a has 469 of 805 bases (58%) identical to a *Saccharomyces cerevisiae* methionine aminopeptidase I (MAP1) mRNA (gb:GENBANK-ID:YSCMAP1A|acc:M77092.1) ($E=1.1e^{-20}$).

A NOV19a polypeptide (SEQ ID NO:44) encoded by SEQ ID NO:43 is 315 amino acid residues and is presented using the one letter code in Table 19B. Signal P, Psort and/or Hydropathy results predict that NOV19a contains a signal peptide and is likely to be localized in the cytoplasm with a certainty of 0.450.

NOV19a is expressed in at least the following tissues: Adrenal Gland/Suprarenal gland, Artery, Bone Marrow, Brain, Colon, Pituitary Gland and Whole Organism. This information was derived by determining the tissue sources of the sequences that were included in the invention including but not limited to SeqCalling sources, Public EST sources, Literature sources, and/or RACE sources.

NOV19b

A disclosed NOV19b nucleic acid of 1018 nucleotides (designated CuraGen Acc. No. CG50287-01) encoding a novel Methionin Aminopeptidase-like protein is shown in Table 19C. An open reading frame was identified beginning

TABLE 19B

| NOV19a protein sequence |
|---|
| (SEQ ID NO:44) |
| SPLNHIYLHKQSSSQQRRNFFFRRQRDISHSIVLPAAVSSAHPVPKHIKKPDYVTTGIVPDWGDSIEVKNEDQIQGLHQACQL |
| ARHVLLLAGKSLKVDMTTEEIDALVHREIISHNAYPSPLGYGGFPKSVCTSVNNVLCHGIPDSRPLQDGDIINIDVTVYYNGY |
| HGDTSETFLVGNVDECGKKLVEVARRCDRDEAIAACRAGAPSVIGNTISHITHQNGFQVCPHFVGHGIGSYPHGHPEIWHHAN |
| DSDLPMEEGMAFTIEPIITEGSPEFKVLEDAWTVVSLDNQRSAQFEHTVLITSRGAQILTKLPHEA |

The NOV19a amino acid sequence has 143 of 267 amino acid residues (53%) identical to, and 173 of 267 amino acid residues (64%) similar to, a *Arabidopsis thaliana* 369 amino acid residue putative methionine aminopeptidase (ptnr:TREMBLNEW-ACC:AAG09564) ($E=5.7e^{-53}$).

with an ATC codon at nucleotides 71–73 and ending with a TGA codon at nucleotides 994–996. A putative untranslated region downstream from the termination codon is underlined in Table 19C, and the start and stop codons are in bold letters.

TABLE 19C

| NOV19b Nucleotide Sequence |
|---|
| (SEQ ID NO:45) |
| GGCGCCCAGCGGCTTGCACCTGTTCGTCCGAAGAGGTTGTCATAGGATTTTCTGATCACCACTCAATCAT**ATC**TACTTA |
| CACAAGCAGTCAAGCAGTCAACAAAGAAGAAATTTCTTTTTTCGGAGACAAAGAGATATTTCACACAGTATAGTTTTGC |
| CGGCTGCAGTTTCTTCAGCTCATCCGGTTCCTAAGCACATAAAGAAGCCAGACTATGTGACGACAGGCATTGTACCAGA |
| CTGGGGAGACAGCATAGAAGTTAAGAATCAAGATCAGATTCAAGGGCTTCATCAGGCTTGTCAGCTGGCCCGCCACGTC |
| CTCCTCTTGGCTGGGAAGAGTTTAAAGGTTGACATGACAACTGAAGAGATAGATGCTCTTGTTCATCGGGAAATCATCA |
| GTCATAATGCCTATCCCTCACCTCTAGGCTATGGAGGTTTTCCAAAATCTGTTTGTACCTCTGTAAACAACGTGCTCTG |
| TCATGGTATTCCTGACAGTCGACCTCTTCAGGATGGAGATATTATCAACATTGATGTCACAGTCTATTACAATGGCTAC |
| CATGGAGACACCTCTGAAACATTTTTGGTGGGCAATGTGGACGAATGTGCTAAAAAGTTAGTGGAGGTTGCCAGGAGGT |
| GTAGAGATGAAGCAATTGCAGCTTGCAGAGCAGGGGCTCCCTTCTCTGTAATTGGAAACACAATCAGCCACATAACTCA |
| TCAGAATGGTTTTCAAGTCTGTCCACATTTTGTGGGACATGGAATAGGATCTTACTTTCATGGACATCCAGAAATTTGG |
| CATCATGCAAACGACAGTGATCTACCCATGGAGGAGCGCATGGCATTCACTATAGAGCCAATCATCACGGAGGGATCCC |
| CTGAATTTAAAGTCCTGGAGGATGCATGGACTGTGGTCTCCCTAGACAATCAAAGGTCGGCGCAGTTCGAGCACACGGT |
| TCTGATCACGTCGAGGGGCGCGCAGATCCTGACCAAACTACCCCA**TGA**GGCCTGAGGAGCCGCCCGAAGG |

A NOV19b polypeptide (SEQ ID NO:46) encoded by SEQ ID NO:45 is 310 amino acid residues and is presented using the one letter code in Table 19D.

TABLE 19D

| NOV19b protein sequence |
|---|
| (SEQ ID NO:46) |
| IYLHKQSSSQQRRNFFFRRQRDISHSIVLPAAVSSAHPVPKHIKKPDYVTTGIVPDWGDSIEVKNEDQIQGLHQACQLARHVL |
| LLAGKSLKVDMTTEEIDALVHREIISHNAYPSPLGYGGFPKSVCTSVNNVLCHGIPDSRPLQDGDIINIDVTVYYNGYHGDTS |
| ETFLVGNVDECGKKLVEVARRCRDEAIAACRAGAPFSVIGNTISHITHQNGFQVCPHFVGHGIGSYFHGHPEIWHHANDSDLP |
| MEEGMAFTIEPIITEGSPEFKVLEDAWTVVSLDNQRSAQFEHTVLITSRGAQILTKLPHEA |

NOV19c

A disclosed NOV19c nucleic acid of 1042 nucleotides (designated CuraGen Acc. No. CG50287-03) encoding a novel Methionin Aminopeptidase-like protein is shown in Table 19E. An open reading frame was identified beginning with an ATG codon at nucleotides 21–23 and ending with a TGA codon at nucleotides 1026–1028. A putative untranslated region downstream from the termination codon is underlined in Table 19E, and the start and stop codons are in bold letters.

TABLE 19E

| NOV19c Nucleotide Sequence |
|---|
| (SEQ ID NO:47) |
| GCCACGTGACCGACGCCAAC**ATG**GCGGCGCCCAGTGGCGTCCACCTGCTCGTCCGCAGAGGTTCTCATAGAATTTTCTC |
| TTCACCACTCAATCATATCTACTTACACAAGCAGTCAAGCAGTCAACAAAGAAGAAATTTCTTTTTTCGGAGACAAAGA |
| GATATTTCACACAGTATAGTTTCGCCGGCTGCAGTTTCTTCAGCTCATCCGGTTCCTAAGCACATAAAGAAGCCAGACT |
| ATGTGACGACAGGCATTGTACCAGACTGGGGAGACAGCATAGAAGTTAAGAATGAAGATCAGATTCAAGGGCTTCATCA |
| GGCTTGTCAGCTGGCCCGCCACGTCCTCCTCTTGGCTGGGAAGAGTTTAAAGGTTGACATGACAACTGAAGAGATAGAT |
| GCTCTTGTTCATCGGGAAATCATCAGTCATAATGCCTATCCCTCACCTCTAGGCTATGGAGGTTTTCCAAAATCTGTTT |
| GTACCTCTGTAAACAACGTGCTCTGTCATGGTATTCCTGACAGTCGACCTCTTCAGGATGGAGATATTATCAACATTGA |

TABLE 19E-continued

| NOV19c Nucleotide Sequence |
| --- |
| TGTCACAGTCTATTACAATGGCTACCATGGAGACACCTCTGAAACATTTTTGGTGGGCAATGTGGACGAATGTGGTAAA |
| AAGTTAGTGGAGGTTGCCAGGAGGTGTAGAGATGAAGCAATTGCAGCTTGCAGAGCAGGGGCTCCCTTCTCTGTAATTG |
| GAAACACAATCAGCCACATAACTCATCAGAATGGTTTTCAAGTCTGTCCACATTTTGTGGGACATGGAATAGGATCTTA |
| CTTTCATGGACATCCAGAAATTTGGCATCATGCAAACGACAGTGATCTACCCATGGAGGAGGGCATGGCATTCACTATA |
| GAGCCAATCATCACGGAGGGATCCCCTGAATTTAAAGTCCTGGAGGATGCATGGACTGTGGTCTCCCTAGACAATCAAA |
| GGTCGGCGCAGTTCGAGCACACGGTTCTGATCACGTCGAGGGGCGCGCAGATCCTGACCAAACTACCCCATGAGGCC**TG** |
| **A**GGAGCCGCCCGAAG |

The nucleic acid sequence of NOV19c maps to chromosome 2 and has 532 of 866 bases (61%) identical to a *Arabidopsis thaliana* methionine aminopeptidase mRNA (gb:GENBANK-ID:AF250963|acc:AF250963.1) ($E=3.5e^{-36}$).

A NOV19c polypeptide (SEQ ID NO:48) encoded by SEQ ID NO:47 is 335 amino acid residues and is presented using the one letter code in Table 19F. Signal P, Psort and/or Hydropathy results predict that NOV19c contains a signal peptide and is likely to be localized in the mitochondrial matrix space with a certainty of 0.4760.

TABLE 19F

| NOV19c protein sequence |
| --- |
| (SEQ ID NO:48) |
| MAAPSGVHLLVRRGSHRIFSSPLNHIYLHKQSSSQQRRNFFFRRQRDISHSIVSPAAVSSAHPVPKHIKKPDYVTTGIVPDWG |
| DSIEVKNEDQIQGLHQACQLARHVLLLAGKSLKVDMTTEEIDALVHREIISHNAYPSPLGYGGFPKSVCTSVNNVLCHGIPDS |
| RPLQDGDIINIDVTVYYNGYHGDTSETFLVGNVDECGKKLVEVARRCRDEAIAACRAGAPFSVIGNTISHITHQNGFQVCPHF |
| VGHGIGSYFHGHPEIWHHANDSDLPMEEGMAFTIEPIITEGSPEFKVLEDAWTVVSLDNQRSAQFEHTVLITSRGAQILTKLP |
| HEA |

The NOV19c amino acid sequence has 306 of 335 amino acid residues (91%) identical to, and 315 of 335 amino acid residues (94%) similar to, a *Mus musculus* 335 amino acid residue 2310066F24RIK protein (ptnr:SPTREMBL-ACC:Q9CPW9) ($E=4.4e^{-166}$).

NOV19c is expressed in at least the following tissues: Mammalian Tissue, Artery, Adrenal Gland/Suprarenal gland, Colon, Bone Marrow, Brain, Pituitary Gland and Placenta. This information was derived by determining the tissue sources of the sequences that were included in the invention including but not limited to SeqCalling sources, Public EST sources, Literature sources, and/or RACE sources.

Possible small nucleotide polymorphisms (SNPs) found for NOV19a are listed in Table 19G.

TABLE 19G

| SNPs | | | | |
| --- | --- | --- | --- | --- |
| Variant | Nucleotide Position | Base Change | Amino Acid Position | Base Change |
| 13376475 | 79 | C > T | Silent | N/A |
| 13376474 | 330 | T > C | 105 | Ile > Thr |

TABLE 19G-continued

| SNPs | | | | |
| --- | --- | --- | --- | --- |
| Variant | Nucleotide Position | Base Change | Amino Acid Position | Base Change |
| 13376473 | 336 | A > G | 107 | Asn > Ser |
| 13376472 | 472 | A > G | Silent | N/A |
| 13376471 | 764 | G > A | 250 | Val > Met |

NOV19a–NOV19c are very closely homologous as is shown in the amino acid alignment in Table 19H.

Table 19H Amino Acid Alignment of NOV19a - NOV19c

```
                     10        20        30        40        50        60        70
             ....|....|....|....|....|....|....|....|....|....|....|....|....|....|
NOV19a       --------------------SFINHIYLHKQSSSQQRFNFFFRRQRDISHSIVLPAAVSSAHPVPKHIKH
NOV19b       -------------------------IYLHKQSSSQQRFNFFFRRQRDISHSIVLPAAVSSAHPVPKHIKH
NOV19c       MAAPSGVHLLVRRGSHRIFSSFLNHIYLHKQSSSQQRFNFFFRRQRDISHSIVSPAAVSSAHPVPKHIKH

                     80        90       100       110       120       130       140
             ....|....|....|....|....|....|....|....|....|....|....|....|....|....|
NOV19a       PDYVTTGIVPDWGDSIEVKNEDQIQGLHQACQLARHVLLLACKSLKVDMTTEEIDALVHREIISHNAYPS
NOV19b       PDYVTTGIVPDWGDSIEVKNEDQIQGLHQACQLARHVLLLACKSLKVDMTTEEIDALVHREIISHNAYPS
NOV19c       PDYVTTGIVPDWGDSIEVKNEDQIQGLHQACQLARHVLLLACKSLKVDMTTEEIDALVHREIISHNAYPS

                    150       160       170       180       190       200       210
             ....|....|....|....|....|....|....|....|....|....|....|....|....|....|
NOV19a       PLGYGGFPKSVCTSVNNVLCHGIPDSRPLQDGDIINIDVTVYYNGYHGDTSETFLVGNVDECGKKLVEVA
NOV19b       PLGYGGFPKSVCTSVNNVLCHGIPDSRPLQDGDIINIDVTVYYNGYHGDTSETFLVGNVDECGKKLVEVA
NOV19c       PLGYGGFPKSVCTSVNNVLCHGIPDSRPLQDGDIINIDVTVYYNGYHGDTSETFLVGNVDECGKKLVEVA

                    220       230       240       250       260       270       280
             ....|....|....|....|....|....|....|....|....|....|....|....|....|....|
NOV19a       RRCRDEAIAACRAGAPFSVIGNTISHITHQNGFQVCPHFVGHGIGSYFHGHPEIWHHANDSDLPMEEGMA
NOV19b       RRCRDEAIAACRAGAPFSVIGNTISHITHQNGFQVCPHFVGHGIGSYFHGHPEIWHHANDSDLPMEEGMA
NOV19c       RRCRDEAIAACRAGAPFSVIGNTISHITHQNGFQVCPHFVGHGIGSYFHGHPEIWHHANDSDLPMEEGMA

                    290       300       310       320       330
             ....|....|....|....|....|....|....|....|....|....|....|
NOV19a       FTIEPIITEGSPEFKVLEDAWTVVSLINQRSAQFEHTVLITSRGAQILTKLPHEA
NOV19b       FTIEPIITEGSPEFKVLEDAWTVVSLINQRSAQFEHTVLITSRGAQILTKLPHEA
NOV19c       FTIEPIITEGSPEFKVLEDAWTVVSLINQRSAQFEHTVLITSRGAQILTKLPHEA
```

Homologies to any of the above NOV19 proteins will be shared by the other NOV19 proteins insofar as they are homologous to each other as shown above. Any reference to NOV19 is assumed to refer to any of the NOV19 proteins in general, unless otherwise noted.

NOV19a also has homology to the amino acid sequences shown in the BLASTP data listed in Table 19I.

TABLE 19I

BLAST results for NOV19a

| Gene Index/ Identifier | Protein/Organism | Length (aa) | Identity (%) | Positives (%) | Expect |
|---|---|---|---|---|---|
| gi\|17975502\|ref\|NP_079909.1\| (NM_025633) | methionine aminopeptidase-like 1 [*Mus musculus*] | 335 | 279/315 (88%) | 286/315 (90%) | e-162 |
| gi\|15982236\|emb\|CAC88860.1\| (AJ414378) | putative methionyl aminopeptidase [*Mus musculus*] | 217 | 204/217 (94%) | 207/217 (95%) | e-117 |
| gi\|15222218\|ref\|NP_172785.1\| (NC_003070) | methionine aminopeptidase I (MAP1), putative [*Arabidopsis thaliana*] | 369 | 143/267 (53%) | 173/267 (64%) | 5e-77 |
| gi\|11320956\|gb\|AAG33975.1\|AF250961_1 (AF250961) | methionine aminopeptidase-like protein [*Arabidopsis thaliana*] | 369 | 143/267 (53%) | 174/267 (64%) | 8e-77 |
| gi\|7297697\|gb\|AAF52949.1\| (AE003628) | CG5188 gene product [*Drosophila melanogaster*] | 307 | 145/282 (51%) | 181/282 (63%) | 3e-76 |

The homology of these sequences is shown graphically in the ClustalW analysis shown in Table 19J.

Table 19J ClustalW Analysis of NOV19a

1) NOV19a (SEQ ID NO:44)
2) gi|17975502|ref|NP_079909.1| (NM_025633) methionine aminopeptidase-like 1 [Mus musculus] (SEQ ID NO:184)
3) gi|15982236|emb|CAC88860.1| (AJ414378) putative methionyl aminopeptidase [Mus musculus] (SEQ ID NO:185)
4) gi|15222218|ref|NP_172785.1| (NC_003070) methionine aminopeptidase I (MAP1), putative [Arabidopsis thaliana] (SEQ ID NO:186)
5) gi|11320956|gb|AAG33975.1|AF250961_1 (AF250961) methionine aminopeptidase-like protein [Arabidopsis thaliana] (SEQ ID NO:187)
6) gi|7297697|gb|AAF52949.1| (AE003628) CG5188 gene product [Drosophila melanogaster] (SEQ ID NO:188)

```
                         10        20        30        40        50        60        70
                 ....|....|....|....|....|....|....|....|....|....|....|....|....|....|
NOV19a           ----------------------------------SPLNHIYLHKQSSSQQRRNFFFRRQRDISHSIVL-
gi|17975502|     ---------------MAAPIGVPLLVRGGCQRIFSSPLNHIYLHKRSGSQQRRHFFFWRQRDISHSVVS-
gi|15982236|     ----------------------------------------------------------------------
gi|15222218|     MASSVFLSSFSSSSSLQLCSSFHGEYLAPSRCFSGSPSSSSSLSLSG----RRNSVSPRGFHVGAKKVSG
gi|11320956|     MASSVFLSSFSSSSSLQLCSSFHGEYLAPSRCFSGSPSSSSSLSLSG----RRNSVSPRGFHVGAKKVSG
gi|7297697|      ---------------------------------GSGSALSGLYSDG--------DTYPDTGKYEQIVS-

                         80        90       100       110       120       130       140
                 ....|....|....|....|....|....|....|....|....|....|....|....|....|....|
NOV19a           ---------------------------PAAVSSAHPVPKHIKKPDYVTTGIVPD-WGDSIEVKNEDQIQGL
gi|17975502|     ---------------------------PAAVSEAHPVPKRIKKPDYVTTGIVPD-WGDSIEVKDEDQIQGL
gi|15982236|     ----------------------------------------------------------------------
gi|15222218|     LEEAIRIRKMRELETKSKVRRNPPLRRGRVSSRLLVPDHIPRPPYVESGRVP-DISSEFQVPGPEGLAKL
gi|11320956|     LEEAIRIRKMRELETKSKVRRNPPLRRGRVSSRLLVPDHIPRPPYVESGRVP-DISSEFQVPGPEGLAKL
gi|7297697|      ---------------------------TGQVSPERFVIEEKKKPAPYFKNIPEGTTLGSPKIKSQVQEDAL

                        150       160       170       180       190       200       210
                 ....|....|....|....|....|....|....|....|....|....|....|....|....|....|
NOV19a           HQACQLARHVLLLAGKSLKVDMTTEEIDALVHREIISHNAYPSPLGYGGFPKSVCTSVNNVLCHGIPDSR
gi|17975502|     REACRLARHVLLLAGKSLKVDMITEEIDALVHWEIIRHDAYPSPLGYGRFPKSVCTSVNNVLCHGIPDSR
gi|15982236|     ----------------------MITEEIDALVHWEIIRHDAYPSPLGYGRFPKSVCTSVNNVLCHGIPDSR
gi|15222218|     RAACELAARVLNYAGTLLKPSVTINEIDKAVHDMIIEAGAYPSPLGYGGFPKSVCTSVNECVCHGIPDSR
gi|11320956|     RAACELAARVLNYAGTLLKPSVTINEIDKAVHDMIIEAGAYPSPLGYGGFPKSVCTSVNECVCHGIPDSR
gi|7297697|      RLAGRLAARILREQGKLATVGTTLDEIDAFAHERIIESKAYPSPLRYAGFPKSICTSINNVACHGIPDDR

                        220       230       240       250       260       270       280
```

```
NOV19a        PLQDGDIINIDVTVYYRGYHGDTSETFLVGNVDECGRKIVEVAFRGRLAAFAASAAEPFSVIGNTISHI
gi|17975502|  PLQDGDIINIDVTVYYRGYHGDTSETFLVGNVDESGRKLVEVAFRGRLAAFAASAAAPFSVIGNTISRI
gi|15982236|  PLQLGDIINIDVTVYYRGYHGDTSETFLVGNVDESGRKLVEVAFRGRLAAIAASAAAPFSVIGTTISRI
gi|15222218|  QLCSGDIINIDVTVVLDGYHGDTSRTFFCGEVDEGFKRLVKVTEECLERGIAVCKDGASFKKIGKRISEH
gi|11320956|  QLCSGDIINIDVTVVLDGYHGDTSRTFFCGEVDEGFKRLVKVTEECLERGIAVCKDGASFKKIGKRISEH
gi|7297697|   QLADCDIINIDVTVYLNGYHGDCSETFRVGNVDERAGFHVVEATKSCLDECIKLGGPGVEFKEIGKFFDRY

                      290       300       310       320       330       340       350
NOV19a        THQNEFRVCPHFVGHGIGSYFHCHPEIWHHANDSDLPMEPGMAFTIEPIITEGSPEFKVLEDAWTVVSLD
gi|17975502|  THQNSLAVCPHFVGHGIGSYFHCHPEIWHHANNNDLPMEPGMAFTIEPIITEGKPEFKVLEDAWTVVSLD
gi|15982236|  THQNSLAVCPHFVGHGIGSYFHCHPEIWHHANNNDLPMEPGMAFTIEPIITEGKPEFKVLEDAWTVVSLD
gi|15222218|  AEKFGYNVVERFVGHGVGPVFHSEPLILHHRNNEPGLMVEGQTFTIEPILTISKTECVTWPDNWTTVTAD
gi|11320956|  AEKFGYNVVERFVGHGVGPVFHSEPLILHHRNNEPGLMVEGQTFTIEPILTISKTECVTWPDNWTTVTAD
gi|7297697|   CDAHDLASIAAFVGHGIGSYFHGPPEILHYYNHIPGKMEPGMTFTIEPILSLGGAHIAVLQDGWIAVSLD

                      360       370
NOV19a        NQRSAQFEHTVLITSRGAQIITKLPHEA
gi|17975502|  NQRSAQFEHTVLITPRGVEILTKLPQEA
gi|15982236|  NQRSAQFEHTVLITPRGVEILTKLPQEA
gi|15222218|  GGVRAQFEHTVLITRTGSEILTKC----
gi|11320956|  GGVRAQFEHTVLITRTGSEILTKC----
gi|7297697|   GARSAQFEHTVLITETGTEILTQDQ
```

Table 19K lists the domain description from DOMAIN analysis results against NOV19a. This indicates that the NOV19a sequence has properties similar to those of other proteins known to contain these domains.

TABLE 19K

Domain Analysis of NOV19a

```
gnl|Pfam|pfam00557, Peptidase_M24, metallopeptidase family M24 (SEQ ID NO:189)
Length = 243 residues, 98.8% aligned
Score = 179 bits (454), Expect = 2e-46

NOV19a:   68 VKNEDQIQGLHQACQLARHVLLLAGKSLKVDMTTEEIDALVHREIISHN-AYPSPLGY--     124
             +K+ ++I+ + +A ++AR V     +++K  MT  EI   +   I     A P+  GY
00557:     2 IKSPEEIEKMRKAGEIARRVHRAVVEAIKPGMTELEIAEEIEYAIRKRGGADPAFYGYIV      61

NOV19a:  125 GGFPKSVCTSVNNVLCHGIPDSRPLQDGDIINIDVTVYYNGYHGDTSETFLVGNVDECGK     184
              GFP S+  SVN  + H  PD R L+DGDI+ ID    Y+GYHGD + TF VG      +
00557:    62 IGFPTSI--SVNEAVAHYSPDDRVLKDGDIVLIDAGAEYDGYHGDIARTFPVGKPTPDAR     119

NOV19a:  185 KLVEVARRCRDEAIAACRAGAPPFSVIGNTISHITHQNG--FQVCPHFVGHGIGSYFHGHP    242
             KL E     ++ AI A + G   S I   I  +        +   H +GHGIG   H  P
00557:   120 KLYEAVLEAQEAAIEAIKPGNTLSDIHAAIQKVAESELGQCKPVRHGLGHGIGLDVHDVP     179

NOV19a:  243 EIWHHANDSDLPMEEGMAFTIEPIITEGSPEFKVLEDAWTVVSLDNQRSAQFEHTVLITS     302
              +  +       +EEGM FTIEP + G    +   D W    +D   S Q E T+ +T
00557:   180 GVPQYDRGDTRVLEEGMVFTIEPGVYFGGVPGRTRGDGWVRIEDDIVVSEQGEETLTVTP     239

NOV19a:  303 RG 304
              G
00557:   240 NG 241
```

Methionine aminopeptidase (MetAP-2) cleaves the N-terminal methionine from newly synthesized NMT protein substrates. The inhibition of new blood vessel formation (angiogenesis) is an effective means of limiting both the size and metastasis of solid tumors. One of the leading angiogenic compounds, fumagillin and its derivative TNP-470, inhibits neovascularization via endothelial cell cycle arrest in the late G1 phase. Because TNP-470 proved to be effective in in vitro and animal model studies, phase III antitumor clinical trials were initiated. To investigate the molecular mode of action of TNP470, Sin et al. (Sin et al., Proc. Nat. Acad. Sci. 94: 6099–6103, 1997. PubMed ID: 9177176) used a derivative of the TNP-470 parent compound, the fungal metabolite fumagillin, and purified a mammalian protein from bovine brain lysate that is selectively and covalently bound by this natural product. This fumagillin binding protein was found to be a metalloprotease, methionine aminopeptidase-2 (MetAP2), which is highly conserved between human and *Saccharomyces cerevisiae*. In the absence of MetAP1, a distantly related methionine aminopeptidase, MetAP2 function is essential for vegetative growth in yeast. Sin et al. (1997) demonstrated that fumagillin selectively inhibits the *S. cerevisiae* MetAP2 protein in vivo. The binding is highly specific as judged by the failure of fumagillin to inhibit MetAP1 in vivo.

Fumagillin and ovalicin are structurally related natural products that potently inhibit angiogenesis by blocking endothelial cell proliferation. To determine the structural elements of these inhibitors and methionine aminopeptidase-2 that are involved in this interaction, Griffith et al. (Griffith et al., Proc. Nat. Acad. Sci. 95: 15183–15188, 1998. PubMed ID: 9860943) studied various fumagillin analogs with structural changes. Their results suggested that fumagillin and ovalicin inhibit MetAP2 by irreversible blockage of the active site. Therefore, the novel protein described in this invention is a potential small molecule drug target in tumor angiogenesis.

The N-terminal protein processing pathway is an essential mechanism found in all organisms. However, it is widely believed that deformylase, a key enzyme involved in this process in bacteria, does not exist in eukaryotes, thus making it a target for antibacterial agents such as actinonin. In an attempt to define this process in higher eukaryotes Giglione et al. (EMBO J. 2000;19:5916–29) have used *Arabidopsis thaliana* as a model organism. Two deformylase cDNAs, the first identified in any eukaryotic system, and six distinct methionine aminopeptidase cDNAs were cloned. The corresponding proteins were characterized in vivo and in vitro. Methionine aminopeptidases were found in the cytoplasm and in the organelles, while deformylases were localized in the organelles only. Their work shows that higher plants have a much more complex machinery for methionine removal than previously suspected. They were also able to identify deformylase homologues from several animals and clone the corresponding cDNA from human cells. Their data provide the first evidence that lower and higher eukaryotes, as well as bacteria, share a similar N-terminal protein processing machinery, indicating universality of this system.

The above defined information for NOV19 suggests that this NOV19 protein may function as a member of a Methionin Aminopeptidase protein family. Therefore, the NOV19 nucleic acids and proteins of the invention are useful in potential therapeutic and diagnostic applications. For example, a cDNA encoding the NOV19 protein may be useful in gene therapy, and the NOV19 protein may be useful when administered to a subject in need thereof. By way of nonlimiting example, the compositions of the present invention will have efficacy for treatment of patients suffering from adrenoleukodystrophy, congenital adrenal hyperplasia, atherosclerosis, aneurysm, hypertension, fibromuscular dysplasia, scleroderma, transplantation, hemophilia, hypercoagulation, idiopathic thrombocytopenic purpura, autoimmune disease, allergies, immunodeficiencies, graft versus host disease, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, Hirschsprung's disease, Crohn's Disease, appendicitis, endocrine dysfunctions, diabetes, obesity, growth and reproductive disorders. The NOV19 nucleic acid encoding Methionin Aminopeptidase-like protein, and the Methionin Aminopeptidase-like protein of the invention, or fragments thereof, may further be useful in diagnostic applications, wherein the presence or amount of the nucleic acid or the protein are to be assessed.

NOVX Nucleic Acids and Polypeptides

One aspect of the invention pertains to isolated nucleic acid molecules that encode NOVX polypeptides or biologically active portions thereof. Also included in the invention are nucleic acid fragments sufficient for use as hybridization probes to identify NOVX-encoding nucleic acids (e.g., NOVX mRNAs) and fragments for use as PCR primers for the amplification and/or mutation of NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

An NOVX nucleic acid can encode a mature NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter-length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS:1, 3, 5, 7, 9, 11, 13, 15, 17, 19, 21, 23, 25, 27, 29, 31, 33, 34, 35, 37, 39, 41, 43, 45, 47 and 49, or a complement of this aforementioned nucleotide sequence, can be isolated using standard molecular biology techniques and the sequence information provided herein. Using all or a portion of the nucleic acid sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49 as a hybridization probe, NOVX molecules can be isolated using standard hybridization and cloning techniques (e.g., as described in Sambrook, et al., (eds.), Molecular Cloning: A Laboratory Manual 2$^{nd}$ Ed., Cold Spring Harbor Laboratory Press, Cold Spring Harbor, N.Y., 1989; and Ausubel, et al., (eds.), Current Protocols in Molecular Biology, John Wiley & Sons, New York, N.Y., 1993.)

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS:1, 3, 5, 7, 9, 11, 13, 15, 17, 19, 21, 23, 25, 27, 29, 31, 33, 34, 35, 37, 39, 41, 43, 45, 47 and 49, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS:1, 3, 5, 7, 9, 11, 13, 15, 17, 19, 21, 23, 25, 27, 29, 31, 33, 34, 35, 37, 39, 41, 43, 45, 47 and 49, or a portion of this nucleotide sequence (e.g., a fragment that can be used as a probe or primer or a fragment encoding a biologically-active portion of an NOVX polypeptide). A nucleic acid molecule that is complementary to the nucleotide sequence shown SEQ ID NOS:1, 3, 5, 7, 9, 11, 13, 15, 17, 19, 21, 23, 25, 27, 29, 31, 33, 34, 35, 37, 39, 41, 43, 45, 47 and 49 is one that is sufficiently complementary to the nucleotide sequence shown NOS:1, 3, 5, 7, 9, 11, 13, 15, 17, 19, 21, 23, 25, 27, 29, 31, 33, 35, 37, 39 or 41 that it can hydrogen bond with little or no mismatches to the nucleotide sequence shown SEQ ID NOS:1, 3, 5, 7, 9, 11, 13, 15, 17, 19, 21, 23, 25, 27, 29, 31, 33, 34, 35, 37, 39, 41, 43, 45, 47 and 49, thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than fill length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., Current Protocols in Molecular Biology, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human NOVX protein. Homologous nucleic acid sequences include those nucleic acid sequences that encode conservative amino acid substitutions (see below) in SEQ ID NOS:1, 3, 5, 7, 9, 11, 13, 15, 17, 19, 21, 23, 25, 27, 29, 31, 33, 34, 35, 37, 39, 41, 43, 45, 47 and 49, as well as a polypeptide possessing NOVX biological activity. Various biological activities of the NOVX proteins are described below.

An NOVX polypeptide is encoded by the open reading frame ("ORF") of an NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a fall protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a bona fide cellular protein, a minimum size requirement is often set, e.g., a stretch of DNA that would encode a protein of 50 amino acids or more.

The nucleotide sequences determined from the cloning of the human NOVX genes allows for the generation of probes and primers designed for use in identifying and/or cloning NOVX homologues in other cell types, e.g. from other tissues, as well as NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS:1, 3, 5, 7, 9, 11, 13, 15, 17, 19, 21, 23, 25, 27, 29, 31, 33, 34, 35, 37, 39, 41, 43, 45, 47 and 49; or an anti-sense strand nucleotide sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49; or of a naturally occurring mutant of SEQ ID NOS:1, 3, 5, 7, 9, 11, 13, 15, 17, 19, 21, 23, 25, 27, 29, 31, 33, 34, 35, 37, 39, 41, 43, 45, 47 and 49.

Probes based on the human NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an NOVX protein, such as by measuring a level of an NOVX-encoding nucleic acid in a sample of cells from a subject e.g., detecting NOVX mRNA levels or determining whether a genomic NOVX gene has been mutated or deleted.

"A polypeptide having a biologically-active portion of an NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically-active portion of NOVX" can be prepared by isolating a portion SEQ ID NOS:1, 3, 5, 7, 9, 11, 13, 15, 17, 19, 21, 23, 25, 27, 29, 31, 33, 34, 35, 37, 39, 41, 43, 45, 47 and 49, that encodes a polypeptide having an NOVX biological activity (the biological activities of the NOVX proteins are described below), expressing the encoded portion of NOVX protein (e.g., by recombinant expression in vitro) and assessing the activity of the encoded portion of NOVX.

NOVX Nucleic Acid and Polypeptide Variants

The invention further encompasses nucleic acid molecules that differ from the nucleotide sequences shown in SEQ ID NOS:1, 3, 5, 7, 9, 11, 13, 15, 17, 19, 21, 23, 25, 27, 29, 31, 33, 34, 35, 37, 39, 41, 43, 45, 47 and 49 due to degeneracy of the genetic code and thus encode the same NOVX proteins as that encoded by the nucleotide sequences shown in SEQ ID NOS:1, 3, 5, 7, 9, 11, 13, 15, 17, 19, 21, 23, 25, 27, 29, 31, 33, 34, 35, 37, 39, 41, 43, 45, 47 and 49. In another embodiment, an isolated nucleic acid molecule of the invention has a nucleotide sequence encoding a protein having an amino acid sequence shown in SEQ ID NOS:2, 4, 6, 8, 10, 12, 14, 16, 18, 20, 22, 24, 26, 28, 30, 32, 36, 38, 40, 42, 44, 46, 48 and 50.

In addition to the human NOVX nucleotide sequences shown in SEQ ID NOS:1, 3, 5, 7, 9, 11, 13, 15, 17, 19, 21, 23, 25, 27, 29, 31, 33, 34, 35, 37, 39, 41, 43, 45, 47 and 49, it will be appreciated by those skilled in the art that DNA sequence polymorphisms that lead to changes in the amino acid sequences of the NOVX polypeptides may exist within a population (e.g., the human population). Such genetic polymorphism in the NOVX genes may exist among individuals within a population due to natural allelic variation. As used herein, the terms "gene" and "recombinant gene" refer to nucleic acid molecules comprising an open reading frame (ORF) encoding an NOVX protein, preferably a vertebrate NOVX protein. Such natural allelic variations can typically result in 1–5% variance in the nucleotide sequence of the NOVX genes. Any and all such nucleotide variations and resulting amino acid polymorphisms in the NOVX polypeptides, which are the result of natural allelic variation and that do not alter the functional activity of the NOVX polypeptides, are intended to be within the scope of the invention.

Moreover, nucleic acid molecules encoding NOVX proteins from other species, and thus that have a nucleotide sequence that differs from the human SEQ ID NOS:1, 3, 5, 7, 9, 11, 13, 15, 17, 19, 21, 23, 25, 27, 29, 31, 33, 34, 35, 37, 39, 41, 43, 45, 47 and 49 are intended to be within the scope of the invention. Nucleic acid molecules corresponding to natural allelic variants and homologues of the NOVX cDNAs of the invention can be isolated based on their homology to the human NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (i.e., nucleic acids encoding NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS:1, 3, 5, 7, 9, 11, 13, 15, 17, 19, 21, 23, 25, 27, 29, 31, 33, 34, 35, 37, 39, 41, 43, 45, 47 and 49, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1×SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Kriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS:1, 3, 5, 7, 9, 11, 13, 15, 17, 19, 21, 23, 25, 27, 29, 31, 33, 34, 35, 37, 39, 41, 43, 45, 47 and 49, or fragments, analogs or derivatives thereof, under conditions of low stringency, is provided. A non-limiting example of low stringency hybridization conditions are hybridization in 35% formamide, 5×SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2×SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g., Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. *Proc Natl Acad Sci USA* 78: 6789–6792.

Conservative Mutations

In addition to naturally-occurring allelic variants of NOVX sequences that may exist in the population, the skilled artisan will further appreciate that changes can be introduced by mutation into the nucleotide sequences SEQ ID NOS:1, 3, 5, 7, 9, 11, 13, 15, 17, 19, 21, 23, 25, 27, 29, 31, 33, 34, 35, 37, 39, 41, 43, 45, 47 and 49, thereby leading to changes in the amino acid sequences of the encoded NOVX proteins, without altering the functional ability of said NOVX proteins. For example, nucleotide substitutions leading to amino acid substitutions at "non-essential" amino acid residues can be made in the sequence SEQ ID NOS:2, 4, 6, 8, 10, 12, 14, 16, 18, 20, 22, 24, 26, 28, 30, 32, 36, 38, 40, 42, 44, 46, 48 and 50. A "non-essential" amino acid residue is a residue that can be altered from the wild-type sequences of the NOVX proteins without altering their biological activity, whereas an "essential" amino acid residue is required for such biological activity. For example, amino acid residues that are conserved among the NOVX proteins of the invention are predicted to be particularly non-amenable to alteration. Amino acids for which conservative substitutions can be made are well-known within the art.

Another aspect of the invention pertains to nucleic acid molecules encoding NOVX proteins that contain changes in amino acid residues that are not essential for activity. Such NOVX proteins differ in amino acid sequence from SEQ ID NOS:1, 3, 5, 7, 9, 11, 13, 15, 17, 19, 21, 23, 25, 27, 29, 31, 33, 34, 35, 37, 39, 41, 43, 45, 47 and 49 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS:2, 4, 6, 8, 10, 12, 14, 16, 18, 20, 22, 24, 26, 28, 30, 32, 36, 38, 40, 42, 44, 46, 48 and 50. Preferably, the protein encoded by the nucleic acid molecule is at least about 60% homologous to SEQ ID NOS:2, 4, 6, 8, 10, 12, 14, 16, 18, 20, 22, 24, 26, 28, 30, 32, 36, 38, 40, 42, 44, 46, 48 and 50; more preferably at least about 70% homologous SEQ ID NOS:2, 4, 6, 8, 10, 12, 14, 16, 18, 20, 22, 24, 26, 28, 30, 32, 36, 38, 40, 42, 44, 46, 48 and 50; still more preferably at least about 80% homologous to SEQ ID NOS:2, 4, 6, 8, 10, 12, 14, 16, 18, 20, 22, 24, 26, 28, 30, 32, 36, 38, 40, 42, 44, 46, 48 and 50; even more preferably at least about 90% homologous to SEQ ID NOS:2, 4, 6, 8, 10, 12, 14, 16, 18, 20, 22, 24, 26, 28, 30, 32, 36, 38, 40, 42, 44, 46, 48 and 50; and most preferably at least about 95% homologous to SEQ ID NOS:2, 4, 6, 8, 10, 12, 14, 16, 18, 20, 22, 24, 26, 28, 30, 32, 36, 38, 40, 42, 44, 46, 48 and 50.

An isolated nucleic acid molecule encoding an NOVX protein homologous to the protein of SEQ ID NOS:2, 4, 6, 8, 10, 12, 14, 16, 18, 20, 22, 24, 26, 28, 30, 32, 36, 38, 40, 42, 44, 46, 48 and 50 can be created by introducing one or more nucleotide substitutions, additions or deletions into the nucleotide sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49, such that one or more amino acid substitutions, additions or deletions are introduced into the encoded protein.

Mutations can be introduced into SEQ ID NOS:1, 3, 5, 7, 9, 11, 13, 15, 17, 19, 21, 23, 25, 27, 29, 31, 33, 34, 35, 37, 39, 41, 43, 45, 47 and 49 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g. alanine, valine, leucine, isoleucine, proline, phenylalanine, methionine, tryptophan), beta-branched side chains (e.g. threonine, valine, isoleucine) and aromatic side chains (e.g., tyrosine, phenylalanine, tryptophan, histidine). Thus, a predicted non-essential amino acid residue in the NOVX protein is replaced with another amino acid residue from the same side chain family. Alternatively, in another embodiment, mutations can be introduced randomly along all or part of an NOVX coding sequence, such as by saturation mutagenesis, and the resultant mutants can be screened for NOVX biological activity to identify mutants that retain activity. Following mutagenesis SEQ ID NOS:1, 3, 5, 7, 9, 11, 13, 15, 17, 19, 21, 23, 25, 27, 29, 31, 33, 34, 35, 37, 39, 41, 43, 45, 47 and 49, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant NOVX protein can be assayed for (i) the ability to form protein:protein interactions with other NOVX proteins, other cell-surface proteins, or biologically-active portions thereof, (ii) complex formation between a mutant NOVX protein and an NOVX ligand; or (iii) the ability of a mutant NOVX protein to bind to an intracellular target protein or biologically-active portion thereof; (e.g. avidin proteins).

In yet another embodiment, a mutant NOVX protein can be assayed for the ability to regulate a specific biological function (e.g., regulation of insulin release).

Antisense Nucleic Acids

Another aspect of the invention pertains to isolated antisense nucleic acid molecules that are hybridizable to or complementary to the nucleic acid molecule comprising the nucleotide sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49, or fragments, analogs or derivatives thereof. An "antisense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, antisense nucleic acid molecules are provided that comprise a sequence complementary to at least about 10, 25, 50, 100, 250 or 500 nucleotides or an entire NOVX coding strand, or to only a portion thereof. Nucleic acid molecules encoding fragments, homologs, derivatives and analogs of an NOVX protein of SEQ ID NOS:2, 4, 6, 8, 10, 12, 14, 16, 18, 20, 22, 24, 26, 28, 30, 32, 36, 38, 40, 42, 44, 46, 48 and 50, or antisense nucleic acids complementary to an NOVX nucleic acid sequence of SEQ ID NOS:1, 3, 5, 7, 9, 11, 13, 15, 17, 19, 21, 23, 25, 27, 29, 31, 33, 34, 35, 37, 39, 41, 43, 45, 47 and 49, are additionally provided.

In one embodiment, an antisense nucleic acid molecule is antisense to a "coding region" of the coding strand of a nucleotide sequence encoding an NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the NOVX protein. The term "noncoding region" refers to 5' and 3' sequences which flank the coding region that are not translated into amino acids (i.e., also referred to as 5' and 3' untranslated regions).

Given the coding strand sequences encoding the NOVX protein disclosed herein, antisense nucleic acids of the invention can be designed according to the rules of Watson and Crick or Hoogsteen base pairing. The antisense nucleic acid molecule can be complementary to the entire coding region of NOVX mRNA, but more preferably is an oligonucleotide that is antisense to only a portion of the coding or noncoding region of NOVX mRNA. For example, the antisense oligonucleotide can be complementary to the region surrounding the translation start site of NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an $\alpha$-anomeric nucleic acid molecule. An $\alpha$-anomeric nucleic acid molecule forms specific double-stranded hybrids with complementary RNA in which, contrary to the usual $\beta$-units, the strands run parallel to each other. See, e.g., Gaultier, et al., 1987. *Nucl. Acids Res.* 15: 6625–6641. The antisense nucleic acid molecule can also comprise a 2'-o-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327–330.

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. *Nature* 334: 585–591) can be used to catalytically cleave NOVX mRNA transcripts to thereby inhibit translation of NOVX mRNA. A ribozyme having specificity for an NOVX-encoding nucleic acid can be designed based upon the nucleotide sequence of an NOVX cDNA disclosed herein (i.e., SEQ ID NOS:1, 3, 5, 7, 9, 11, 13, 15, 17, 19, 21, 23, 25, 27, 29, 31, 33, 34, 35, 37, 39, 41, 43, 45, 47 and 49). For example, a derivative of a Tetrahymena L-19 IVS RNA can be constructed in which the nucleotide sequence of the active site is complementary to the nucleotide sequence to be cleaved in an NOVX-encoding mRNA. See, e.g., U.S. Pat. No. 4,987,071 to Cech, et al. and U.S. Pat. No. 5,116,742 to Cech, et al. NOVX mRNA can also be used to select a catalytic RNA having a specific ribonuclease activity from a pool of RNA molecules. See, e.g., Bartel et al., (1993) *Science* 261:1411–1418.

Alternatively, NOVX gene expression can be inhibited by targeting nucleotide sequences complementary to the regulatory region of the NOVX nucleic acid (e.g., the NOVX promoter and/or enhancers) to form triple helical structures that prevent transcription of the NOVX gene in target cells. See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996. supra; Perry-O'Keefe, et al., 1996. *Proc. Natl. Acad. Sci. USA* 93: 14670–14675.

PNAs of NOVX can be used in therapeutic and diagnostic applications. For example, PNAs can be used as antisense or antigene agents for sequence-specific modulation of gene expression by, e.g., inducing transcription or translation arrest or inhibiting replication. PNAs of NOVX can also be used, for example, in the analysis of single base pair mutations in a gene (e.g., PNA directed PCR clamping; as artificial restriction enzymes when used in combination with other enzymes, e.g., $S_1$ nucleases (See, Hyrup, et al., 1996.supra); or as probes or primers for DNA sequence and hybridization (See, Hyrup, et al., 1996, supra; Perry-O'Keefe, et al., 1996. supra).

In another embodiment, PNAs of NOVX can be modified, e.g. to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996. supra). The synthesis of PNA-DNA chimeras can be performed as described in Hyrup, et al., 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g. Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. *Bioorg. Med. Chem. Lett.* 5: 1119–11124.

In other embodiments, the oligonucleotide may include other appended groups such as peptides (e.g., for targeting host cell receptors in vivo), or agents facilitating transport across the cell membrane (see, e.g., Letsinger, et al., 1989. *Proc. Natl. Acad. Sci. U.S.A.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g., Krol, et al., 1988. *BioTechniques* 6:958–976) or intercalating agents (see, e.g., Zon, 1988. *Pharm. Res.* 5: 539–549). To this end, the oligonucleotide may be conjugated to another molecule, e.g., a peptide, a hybridization triggered cross-linking agent, a transport agent, a hybridization-triggered cleavage agent, and the like.

NOVX Polypeptides

A polypeptide according to the invention includes a polypeptide including the amino acid sequence of NOVX polypeptides whose sequences are provided in SEQ ID NOS:2, 4, 6, 8, 10, 12, 14, 16, 18, 20, 22, 24, 26, 28, 30, 32, 36, 38, 40, 42, 44, 46, 48 and 50. The invention also includes a mutant or variant protein any of whose residues may be changed from the corresponding residues shown in SEQ ID NOS:2, 4, 6, 8, 10, 12, 14, 16, 18, 20, 22, 24, 26, 28, 30, 32, 36, 38, 40, 42, 44, 46, 48 and 50 while still encoding a protein that maintains its NOVX activities and physiological functions, or a functional fragment thereof.

In general, an NOVX variant that preserves NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated NOVX proteins, and biologically-active portions thereof, or derivatives, fragments, analogs or homologs thereof. Also provided are polypeptide fragments suitable for use as immunogens to raise anti-NOVX antibodies. In one embodiment, native NOVX proteins can be isolated from cells or tissue sources by an appropriate purification scheme using standard protein purification techniques. In another embodiment, NOVX proteins are produced by recombinant DNA techniques. Alternative to recombinant expression, an NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the NOVX protein is derived, or substantially free from chemical precursors or other chemicals when chemically synthesized. The language "substantially free of cellular material" includes preparations of NOVX proteins in which the protein is separated from cellular components of the cells from which it is isolated or recombinantly-produced. In one embodiment, the language "substantially free of cellular material" includes preparations of NOVX proteins having less than about 30% (by dry weight) of non-NOVX proteins (also referred to herein as a "contaminating protein"), more preferably less than about 20% of non-NOVX proteins, still more preferably less than about 10% of non-NOVX proteins, and most preferably less than about 5% of non-NOVX proteins. When the NOVX protein or biologically-active portion thereof is recombinantly-produced, it is also preferably substantially free of culture medium, i.e., culture medium represents less than about 20%, more preferably less than about 10%, and most preferably less than about 5% of the volume of the NOVX protein preparation.

The language "substantially free of chemical precursors or other chemicals" includes preparations of NOVX proteins in which the protein is separated from chemical precursors or other chemicals that are involved in the synthesis of the protein. In one embodiment, the language "substantially free of chemical precursors or other chemicals" includes preparations of NOVX proteins having less than about 30% (by dry weight) of chemical precursors or non-NOVX chemicals, more preferably less than about 20% chemical precursors or non-NOVX chemicals, still more preferably less than about 10% chemical precursors or non-NOVX chemicals, and most preferably less than about 5% chemical precursors or non-NOVX chemicals.

Biologically-active portions of NOVX proteins include peptides comprising amino acid sequences sufficiently homologous to or derived from the amino acid sequences of the NOVX proteins (e.g., the amino acid sequence shown in SEQ ID NOS:2, 4, 6, 8, 10, 12, 14, 16, 18, 20, 22, 24, 26, 28, 30, 32, 36, 38, 40, 42, 44, 46, 48 and 50) that include fewer amino acids than the full-length NOVX proteins, and exhibit at least one activity of an NOVX protein. Typically, biologically-active portions comprise a domain or motif with at least one activity of the NOVX protein. A biologically-active portion of an NOVX protein can be a polypeptide which is, for example, 10, 25, 50, 100 or more amino acid residues in length.

Moreover, other biologically-active portions, in which other regions of the protein are deleted, can be prepared by recombinant techniques and evaluated for one or more of the functional activities of a native NOVX protein.

In an embodiment, the NOVX protein has an amino acid sequence shown SEQ ID NOS:2, 4, 6, 8, 10, 12, 14, 16, 18, 20, 22, 24, 26, 28, 30, 32, 36, 38, 40, 42, 44, 46, 48 and 50. In other embodiments, the NOVX protein is substantially homologous to SEQ ID NOS:2, 4, 6, 8, 10, 12, 14, 16, 18, 20, 22, 24, 26, 28, 30, 32, 36, 38, 40, 42, 44, 46, 48 and 50, and retains the functional activity of the protein of SEQ ID NOS:2, 4, 6, 8, 10, 12, 14, 16, 18, 20, 22, 24, 26, 28, 30, 32, 36, 38, 40, 42, 44, 46, 48 and 50, yet differs in amino acid sequence due to natural allelic variation or mutagenesis, as described in detail, below. Accordingly, in another embodiment, the NOVX protein is a protein that comprises an amino acid sequence at least about 45% homologous to the amino acid sequence SEQ ID NOS:2, 4, 6, 8, 10, 12, 14, 16, 18, 20, 22, 24, 26, 28, 30, 32, 36, 38, 40, 42, 44, 46, 48 and 50, and retains the functional activity of the NOVX proteins of SEQ ID NOS:2, 4, 6, 8, 10, 12, 14, 16, 18, 20, 22, 24, 26, 28, 30, 32, 36, 38, 40, 42, 44, 46, 48 and 50.

Determining Homology Between Two or More Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS:1, 3, 5, 7, 9, 11, 13, 15, 17, 19, 21, 23, 25, 27, 29, 31, 33, 34, 35, 37, 39, 41, 43, 45, 47 and 49.

The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g., A, T, C, G, U, or I, in the case of nucleic acids) occurs in both sequences to yield the number of matched positions, dividing the number of matched positions by the total number of positions in the region of comparison (i e., the window size), and multiplying the result by 100 to yield the percentage of sequence identity. The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides NOVX chimeric or fusion proteins. As used herein, an NOVX "chimeric protein" or "fusion protein" comprises an NOVX polypeptide operatively-linked to a non-NOVX polypeptide. An "NOVX polypeptide" refers to a polypeptide having an amino acid sequence corresponding to an NOVX protein SEQ ID NOS:2, 4, 6, 8, 10, 12, 14, 16, 18, 20, 22, 24, 26, 28, 30, 32, 36, 38, 40, 42, 44, 46, 48 and 50, whereas a "non-NOVX polypeptide" refers to a polypeptide having an amino acid sequence corresponding to a protein that is not substantially homologous to the NOVX protein, e.g., a protein that is different from the NOVX protein and that is derived from the same or a different organism. Within an NOVX fusion protein the NOVX polypeptide can correspond to all or a portion of an NOVX protein. In one embodiment, an NOVX fusion protein comprises at least one biologically-active portion of an NOVX protein. In another embodiment, an NOVX fusion protein comprises at least two biologically-active portions of an NOVX protein. In yet another embodiment, an NOVX fusion protein comprises at least three biologically-active portions of an NOVX protein. Within the fusion protein, the term "operatively-linked" is intended to indicate that the NOVX polypeptide and the non-NOVX polypeptide are fused in-frame with one another. The non-NOVX polypeptide can be fused to the N-terminus or C-terminus of the NOVX polypeptide.

In one embodiment, the fusion protein is a GST-NOVX fusion protein in which the NOVX sequences are fused to the C-terminus of the GST (glutathione S-transferase) sequences. Such fusion proteins can facilitate the purification of recombinant NOVX polypeptides.

In another embodiment, the fusion protein is an NOVX protein containing a heterologous signal sequence at its N-terminus. In certain host cells (e.g., mammalian host cells), expression and/or secretion of NOVX can be increased through use of a heterologous signal sequence.

In yet another embodiment, the fusion protein is an NOVX-immunoglobulin fusion protein in which the NOVX sequences are fused to sequences derived from a member of the immunoglobulin protein family. The NOVX-immunoglobulin fusion proteins of the invention can be incorporated into pharmaceutical compositions and administered to a subject to inhibit an interaction between an NOVX ligand and an NOVX protein on the surface of a cell, to thereby suppress NOVX-mediated signal transduction in vivo. The NOVX-immunoglobulin fusion proteins can be used to affect the bioavailability of an NOVX cognate ligand. Inhibition of the NOVX ligand/NOVX interaction may be useful therapeutically for both the treatment of proliferative and differentiative disorders, as well as modulating (e.g. promoting or inhibiting) cell survival. Moreover, the NOVX-immunoglobulin fusion proteins of the invention can be used as immunogens to produce anti-NOVX antibodies in a subject, to purify NOVX ligands, and in screening assays to identify molecules that inhibit the interaction of NOVX with an NOVX ligand.

An NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An NOVX-encoding nucleic acid can be cloned into such an expression vector such that the fusion moiety is linked in-frame to the NOVX protein.

NOVX Agonists and Antagonists

The invention also pertains to variants of the NOVX proteins that function as either NOVX agonists (i.e., mimetics) or as NOVX antagonists. Variants of the NOVX protein can be generated by mutagenesis (e.g., discrete point mutation or truncation of the NOVX protein). An agonist of the NOVX protein can retain substantially the same, or a subset of, the biological activities of the naturally occurring form of the NOVX protein. An antagonist of the NOVX protein can inhibit one or more of the activities of the naturally occurring form of the NOVX protein by, for example, competitively binding to a downstream or upstream member of a cellular signaling cascade which includes the NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the NOVX proteins.

Variants of the NOVX proteins that function as either NOVX agonists (i.e., mimetics) or as NOVX antagonists can be identified by screening combinatorial libraries of mutants (e.g., truncation mutants) of the NOVX proteins for NOVX protein agonist or antagonist activity. In one embodiment, a variegated library of NOVX variants is generated by combinatorial mutagenesis at the nucleic acid level and is encoded by a variegated gene library. A variegated library of NOVX variants can be produced by, for example, enzymatically ligating a mixture of synthetic oligonucleotides into gene sequences such that a degenerate set of potential NOVX sequences is expressible as individual polypeptides, or alternatively, as a set of larger fusion proteins (e.g., for phage display) containing the set of NOVX sequences therein. There are a variety of methods which can be used to produce libraries of potential NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential NOVX sequences. Methods for synthesizing degenerate oligonucleotides are well-known within the art. See, e.g. Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 11: 477.

Polypeptide Libraries

In addition, libraries of fragments of the NOVX protein coding sequences can be used to generate a variegated population of NOVX fragments for screening and subsequent selection of variants of an NOVX protein. In one embodiment, a library of coding sequence fragments can be generated by treating a double stranded PCR fragment of an NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with $S_1$ nuclease, and ligating the resulting fragment library into an expression vector. By this method, expression libraries can be derived which encodes N-terminal and internal fragments of various sizes of the NOVX proteins.

Various techniques are known in the art for screening gene products of combinatorial libraries made by point mutations or truncation, and for screening cDNA libraries for gene products having a selected property. Such techniques are adaptable for rapid screening of the a gene libraries generated by the combinatorial mutagenesis of NOVX proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify NOVX variants. See, e.g., Arkin and Yourvan, 1992. *Proc. Natl. Acad. Sci. USA* 89: 7811–7815; Delgrave, et al., 1993. *Protein Engineering* 6:327–331.

Antibodies

The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, antibody molecules obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated protein of the invention intended to serve as an antigen, or a portion or fragment thereof, can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein, such as an amino acid sequence shown in SEQ ID NOS:2, 4, 6, 8, 10, 12, 14, 16, 18, 20, 22, 24, 26, 28, 30, 32, 36, 38, 40, 42, 44, 46, 48 and 50, and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of SECX that is located on the surface of the protein, e.g., a hydrophilic region. A hydrophobicity analysis of the human SECX protein sequence will indicate which regions of a SECX polypeptide are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, Proc. Nat. Acad. Sci. USA 78: 3824–3828; Kyte and Doolittle 1982, J. Mol. Biol. 157: 105–142, each incorporated herein by reference in their entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow E, and Lane D, 1988, Cold Spring Harbor Laboratory Press, Cold Spring Harbor, N.Y., incorporated herein by reference). Some of these antibodies are discussed below.

Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and *Corynebacterium parvum*, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.,* 133:3001 (1984); Brodeur et al., *Monoclonal Antibody Production Techniques and Applications*, Marcel Dekker, Inc., New York, (1987) pp. 51–63].

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.,* 107:220 (1980). It is an objective, especially important in therapeutic applications of monoclonal antibodies, to identify antibodies having a high degree of specificity and a high binding affinity for the target antigen.

After the desired hybridoma cells are identified, the clones can be subcloned by limiting dilution procedures and grown by standard methods (Goding, 1986). Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, *Nature* 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', $F(ab')_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., *Nature,* 321:522–525 (1986); Riechmann et al., *Nature,* 332:323–327 (1988); Verhoeyen et al., *Science* 239:1534–1536 (1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr. Op. Struct. Biol.,* 2:593–596 (1992)).

Human Antibodies

Fully human antibodies essentially relate to antibody molecules in which the entire sequence of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.,* 227:381 (1991); Marks et al., *J. Mol. Biol.* 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in Marks et al. (*Bio/Technology* 10, 779–783 (1992)); Lonberg et al. (*Nature* 368 856–859 (1994)); Morrison (*Nature* 368, 812–13 (1994)); Fishwild et al,(*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

$F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, *Nature,* 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., *EMBO J.,* 10:3655–3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology,* 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. $F(ab')_2$ bispecific antibodies). Techniques for generating bispecific antibodies from antibody fragments have been described in the literature. For example, bispecific antibodies can be prepared using chemical linkage. Brennan et al., *Science* 229:81 (1985) describe a procedure wherein intact antibodies are proteolytically cleaved to generate $F(ab')_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from *E. coli* and chemically coupled to form bispecific antibodies. Shalaby et al., *J. Exp. Med.* 175:217–225 (1992) describe the production of a fully humanized bispecific antibody $F(ab')_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., *J. Immunol.* 148(5): 1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD 16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., *J. Exp Med.,* 176: 1191–1195 (1992) and Shopes, *J. Immunol.,* 148: 2918–2922 (1992). Homodimeric antibodies with enhanced anti-tumor activity can also be prepared using heterobifunctional cross-linkers as described in Wolff et al. *Cancer Research,* 53: 2560–2565 (1993). Alternatively, an antibody can be engineered that has dual Fc regions and can thereby have enhanced complement lysis and ADCC capabilities. See Stevenson et al., *Anti-Cancer Drug Design.* 3: 219–230 (1989).

Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}Bi$, $^{131}I$, $^{131}In$, $^{90}Y$, and $^{186}Re$.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

Immunoliposomes

The antibodies disclosed herein can also be formulated as immunoliposomes. Liposomes containing the antibody are prepared by methods known in the art, such as described in Epstein et al., *Proc. Natl. Acad. Sci. USA,* 82: 3688 (1985); Hwang et al., *Proc. Natl. Acad. Sci. USA,* 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al *J. Biol. Chem.,* 257: 286–288 (1982) via a disulfide-interchange reaction. A chemotherapeutic agent (such as Doxorubicin) is optionally contained within the liposome. See Gabizon et al., *J. National Cancer Inst.,* 81(19): 1484 (1989).

Diagnostic Applications of Antibodies Directed Against the Proteins of the Invention Antibodies directed against a protein of the invention may be used in methods known within the art relating to the localization and/or quantitation of the protein (e.g., for use in measuring levels of the protein within appropriate physiological samples, for use in diagnostic methods, for use in imaging the protein, and the like). In a given embodiment, antibodies against the proteins, or derivatives, fragments, analogs or homologs thereof, that contain the antigen binding domain, are utilized as pharmacologically-active compounds (see below).

An antibody specific for a protein of the invention can be used to isolate the protein by standard techniques, such as immunoaffinity chromatography or immunoprecipitation. Such an antibody can facilitate the purification of the natural protein antigen from cells and of recombinantly produced antigen expressed in host cells. Moreover, such an antibody can be used to detect the antigenic protein (e.g., in a cellular lysate or cell supernatant) in order to evaluate the abundance and pattern of expression of the antigenic protein. Antibodies directed against the protein can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Antibody Therapeutics

Antibodies of the invention, including polyclonal, monoclonal, humanized and fully human antibodies, may used as therapeutic agents. Such agents will generally be employed to treat or prevent a disease or pathology in a subject. An antibody preparation, preferably one having high specificity and high affinity for its target antigen, is administered to the subject and will generally have an effect due to its binding with the target. Such an effect may be one of two kinds, depending on the specific nature of the interaction between the given antibody molecule and the target antigen in question. In the first instance, administration of the antibody may abrogate or inhibit the binding of the target with an endogenous ligand to which it naturally binds. In this case, the antibody binds to the target and masks a binding site of the naturally occurring ligand, wherein the ligand serves as an effector molecule. Thus the receptor mediates a signal transduction pathway for which ligand is responsible.

Alternatively, the effect may be one in which the antibody elicits a physiological result by virtue of binding to an effector binding site on the target molecule. In this case the target, a receptor having an endogenous ligand which may be absent or defective in the disease or pathology, binds the antibody as a surrogate effector ligand, initiating a receptor-based signal transduction event by the receptor.

A therapeutically effective amount of an antibody of the invention relates generally to the amount needed to achieve a therapeutic objective. As noted above, this may be a binding interaction between the antibody and its target antigen that, in certain cases, interferes with the functioning of the target, and in other cases, promotes a physiological response. The amount required to be administered will furthermore depend on the binding affinity of the antibody for its specific antigen, and will also depend on the rate at which an administered antibody is depleted from the free volume other subject to which it is administered. Common ranges for therapeutically effective dosing of an antibody or antibody fragment of the invention may be, by way of nonlimiting example, from about 0.1 mg/kg body weight to about 50 mg/kg body weight. Common dosing frequencies may range, for example, from twice daily to once a week.

Pharmaceutical Compositions of Antibodies

Antibodies specifically binding a protein of the invention, as well as other molecules identified by the screening assays disclosed herein, can be administered for the treatment of various disorders in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

If the antigenic protein is intracellular and whole antibodies are used as inhibitors, internalizing antibodies are preferred. However, liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA,* 90: 7889–7893 (1993). The formulation herein can also contain more than one active compound as necessary for the particular indication being treated, preferably those with complementary activities that do not adversely affect each other. Alternatively, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly (vinylalcohol)), polylactides (U.S. Pat. No. 3,773,919), copolymers of L-glutamic acid and γethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

ELISA Assay

An agent for detecting an analyte protein is an antibody capable of binding to an analyte protein, preferably an antibody with a detectable label. Antibodies can be polyclonal, or more preferably, monoclonal. An intact antibody, or a fragment thereof (e.g., $F_{ab}$ or $F_{(ab)2}$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the invention can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Thory of Enzyme Immunoassays", P. Tijssen, Elsevier Science Publishers, Amsterdam, 1985. Furthermore, in vivo techniques for detection of an analyte protein include introducing into a subject a labeled anti-an analyte protein antibody. For example, the antibody can be labeled with a radioactive marker whose presence and location in a subject can be detected by standard imaging techniques.

NOVX Recombinant Expression Vectors and Host Cells

Another aspect of the invention pertains to vectors, preferably expression vectors, containing a nucleic acid encoding an NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g. in an in vitro transcription/translation system or in a host cell when the vector is introduced into the host cell).

The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., NOVX proteins, mutant forms of NOVX proteins, fusion proteins, etc.).

The recombinant expression vectors of the invention can be designed for expression of NOVX proteins in prokaryotic or eukaryotic cells. For example, NOVX proteins can be expressed in bacterial cells such as *Escherichia coli*, insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. *Gene* 67: 31–40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY185, Academic Press, San Diego, Calif. (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the NOVX expression vector is a yeast expression vector. Examples of vectors for expression in yeast *Saccharomyces cerivisae* include pYepSec1 (Baldari, et al., 1987. *EMBO J.* 6: 229–234), pMFa (Kuijan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Baneiji, et al., 1983. *Cell* 33: 729–740; Queen and Baltimore, 1983. *Cell* 33: 741–748), neuron-specific promoters (e.g., the neurofilament promoter; Byrne and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374–379) and the α-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, NOVX protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) NOVX protein. Accordingly, the invention further provides methods for producing NOVX protein using the host cells of the invention. In one embodiment, the method comprises culturing the host cell of invention (into which a recombinant expression vector encoding NOVX protein has been introduced) in a suitable medium such that NOVX protein is produced. In another embodiment, the method further comprises isolating NOVX protein from the medium or the host cell.

Transgenic NOVX Animals

The host cells of the invention can also be used to produce non-human transgenic animals. For example, in one embodiment, a host cell of the invention is a fertilized oocyte or an embryonic stem cell into which NOVX protein-coding sequences have been introduced. Such host cells can then be used to create non-human transgenic animals in which exogenous NOVX sequences have been introduced into their genome or homologous recombinant animals in which endogenous NOVX sequences have been altered. Such animals are useful for studying the function and/or activity of NOVX protein and for identifying and/or evaluating modulators of NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a transgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing NOVX-encoding nucleic acid into the male pronuclei of a fertilized oocyte (e.g., by microinjection, retroviral infection) and allowing the oocyte to develop in a pseudopregnant female foster animal. The human NOVX cDNA sequences SEQ ID NOS:1, 3, 5, 7, 9, 11, 13, 15, 17, 19, 21, 23, 25, 27, 29, 31, 33, 34, 35, 37, 39, 41, 43, 45, 47 and 49 can be introduced as a transgene into the genome of a non-human animal. Alternatively, a non-human homologue of the human NOVX gene, such as a mouse NOVX gene, can be isolated based on hybridization to the human NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the NOVX transgene to direct expression of NOVX protein to particular cells. Methods for generating transgenic animals via embryo manipulation and microinjection, particularly animals such as mice, have become conventional in the art and are described, for example, in U.S. Pat. Nos. 4,736,866; 4,870,009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the NOVX transgene in its genome and/or expression of NOVX mRNA in tissues or cells of the animals. A transgenic founder animal can then be used to breed additional animals carrying the transgene. Moreover, transgenic animals carrying a transgene-encoding NOVX protein can further be bred to other transgenic animals carrying other transgenes.

To create a homologous recombinant animal, a vector is prepared which contains at least a portion of an NOVX gene into which a deletion, addition or substitution has been introduced to thereby alter, e.g., functionally disrupt, the NOVX gene. The NOVX gene can be a human gene (e.g., the cDNA of SEQ ID NOS:1, 3, 5, 7, 9, 11, 13, 15, 17, 19, 21, 23, 25, 27, 29, 31, 33, 34, 35, 37, 39, 41, 43, 45, 47 and 49), but more preferably, is a non-human homologue of a human NOVX gene. For example, a mouse homologue of human NOVX gene of SEQ ID NOS:1, 3, 5, 7, 9, 11, 13, 15, 17, 19, 21, 23, 25, 27, 29, 31, 33, 34, 35, 37, 39, 41, 43, 45, 47 and 49 can be used to construct a homologous recombination vector suitable for altering an endogenous NOVX gene in the mouse genome. In one embodiment, the vector is designed such that, upon homologous recombination, the endogenous NOVX gene is functionally disrupted (i.e., no longer encodes a functional protein; also referred to as a "knock out" vector).

Alternatively, the vector can be designed such that, upon homologous recombination, .the endogenous NOVX gene is mutated or otherwise altered but still encodes functional protein (e.g., the upstream regulatory region can be altered to thereby alter the expression of the endogenous NOVX protein). In the homologous recombination vector, the altered portion of the NOVX gene is flanked at its 5'- and 3'-termini by additional nucleic acid of the NOVX gene to allow for homologous recombination to occur between the exogenous NOVX gene carried by the vector and an endogenous NOVX gene in an embryonic stem cell. The additional flanking NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is ten introduced into an embryonic stem cell line (e.g., by electroporation) and cells in which the introduced NOVX gene has homologously-recombined with the endogenous NOVX gene are selected. See, e.g., Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Lakso, et al., 1992. *Proc. Natl. Acad. Sci. USA* 89: 6232–6236. Another example of a recombinase system is the FLP recombinase system of *Saccharomyces cerevisiae*. See, O'Gorman, et al., 1991. *Science* 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The NOVX nucleic acid molecules, NOVX proteins, and anti-NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used.

The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an NOVX protein or anti-NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

The pharmaceutical compositions can be included in a container, pack, or dispenser together with instructions for administration.

Screening and Detection Methods

The isolated nucleic acid molecules of the invention can be used to express NOVX protein (e.g., via a recombinant expression vector in a host cell in gene therapy applications), to detect NOVX mRNA (e.g., in a biological sample) or a genetic lesion in an NOVX gene, and to modulate NOVX activity, as described further, below. In addition, the NOVX proteins can be used to screen drugs or compounds that modulate the NOVX protein activity or expression as well as to treat disorders characterized by insufficient or excessive production of NOVX protein or production of NOVX protein forms that have decreased or aberrant activity compared to NOVX wild-type protein (e.g.; diabetes (regulates insulin release); obesity (binds and transport lipids); metabolic disturbances associated with obesity, the metabolic syndrome X as well as anorexia and wasting disorders associated with chronic diseases and various cancers, and infectious disease (possesses anti-microbial activity) and the various dyslipidemias. In addition, the anti-NOVX antibodies of the invention can be used to detect and isolate NOVX proteins and modulate NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to NOVX proteins or have a stimulatory or inhibitory effect on, e.g., NOVX protein expression or NOVX protein activity. The invention also includes compounds identified in the screening assays described herein.

In one embodiment, the invention provides assays for screening candidate or test compounds which bind to or modulate the activity of the membrane-bound form of an NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.A.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int Ed. Engl.* 33: 2059; Carell, et al., 1994. *Angew. Chem. Int. Ed. Engl.* 33: 2061; and Gallop, et al., 1994. *J. Med. Chem.* 37:1233.

Libraries of compounds may be presented in solution (e.g., Houghten, 1992. *Biotechniques* 13: 412–421), or on beads (Lam, 1991. *Nature* 354: 82–84), on chips (Fodor, 1993. *Nature* 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249: 404–406; Cwirla, et al., 1990. *Proc. Natl. Acad. Sci. U.S.A.* 87: 6378–6382; Felici, 1991. *J. Mol. Biol.* 222: 301–310; Ladner, U.S. Pat. No. 5,233,409).

In one embodiment, an assay is a cell-based assay in which a cell which expresses a membrane-bound form of NOVX protein, or a biologically-active portion thereof, on the cell surface is contacted with a test compound and the ability of the test compound to bind to an NOVX protein determined. The cell, for example, can of mammalian origin or a yeast cell.

Determining the ability of the test compound to bind to the NOVX protein can be accomplished, for example, by coupling the test compound with a radioisotope or enzymatic label such that binding of the test compound to the NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of NOVX protein, or a biologically-active portion thereof, on the cell surface with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX protein or a biologically-active portion thereof as compared to the known compound.

In another embodiment, an assay is a cell-based assay comprising contacting a cell expressing a membrane-bound form of NOVX protein, or a biologically-active portion thereof, on the cell surface with a test compound and determining the ability of the test compound to modulate (e.g., stimulate or inhibit) the activity of the NOVX protein or biologically-active portion thereof. Determining the ability of the test compound to modulate the activity of NOVX or a biologically-active portion thereof can be accomplished, for example, by determining the ability of the NOVX protein to bind to or interact with an NOVX target molecule. As used herein, a "target molecule" is a molecule with which an NOVX protein binds or interacts in nature, for example, a molecule on the surface of a cell which expresses an NOVX interacting protein, a molecule on the surface of a second cell, a molecule in the extracellular milieu, a molecule associated with the internal surface of a cell membrane or a cytoplasmic molecule. An NOVX target molecule can be a non-NOVX molecule or an NOVX protein or polypeptide of the invention. In one embodiment, an NOVX target molecule is a component of a signal transduction pathway that facilitates transduction of an extracellular signal (e.g. a signal generated by binding of a compound to a membrane-bound NOVX molecule) through the cell membrane and into the cell. The target, for example, can be a second intercellular protein that has catalytic activity or a protein that facilitates the association of downstream signaling molecules with NOVX.

Determining the ability of the NOVX protein to bind to or interact with an NOVX target molecule can be accomplished by one of the methods described above for determining direct binding. In one embodiment, determining the ability of the NOVX protein to bind to or interact with an NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an NOVX protein or biologically-active portion thereof with a test compound and determining the ability of the test compound to bind to the NOVX protein or biologically-active portion thereof. Binding of the test compound to the NOVX protein can be determined either directly or indirectly as described above. In one such embodiment, the assay comprises contacting the NOVX protein or biologically-active portion thereof with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX or biologically-active portion thereof as compared to the known compound.

In still another embodiment, an assay is a cell-free assay comprising contacting NOVX protein or biologically-active portion thereof with a test compound and determining the ability of the test compound to modulate (e.g. stimulate or inhibit) the activity of the NOVX protein or biologically-active portion thereof. Determining the ability of the test compound to modulate the activity of NOVX can be accomplished, for example, by determining the ability of the NOVX protein to bind to an NOVX target molecule by one of the methods described above for determining direct binding. In an alternative embodiment, determining the ability of the test compound to modulate the activity of NOVX protein can be accomplished by determining the ability of the NOVX protein further modulate an NOVX target molecule. For example, the catalytic/enzymatic activity of the target molecule on an appropriate substrate can be determined as described, supra.

In yet another embodiment, the cell-free assay comprises contacting the NOVX protein or biologically-active portion thereof with a known compound which binds NOVX protein to form an assay mixture, contacting the assay mixture with a test compound, and determining the ability of the test compound to interact with an NOVX protein, wherein determining the ability of the test compound to interact with an NOVX protein comprises determining the ability of the NOVX protein to preferentially bind to or modulate the activity of an NOVX target molecule.

The cell-free assays of the invention are amenable to use of both the soluble form or the membrane-bound form of NOVX protein. In the case of cell-free assays comprising the membrane-bound form of NOVX protein, it may be desirable to utilize a solubilizing agent such that the membrane-bound form of NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, N-dodecyl-N,N-dimethyl-3-ammonio-1-propane sulfonate, 3-(3-cholamidopropyl) dimethylamminiol-1-propane sulfonate (CHAPS), or 3-(3-cholamidopropyl) dimethylamminiol-2-hydroxy-1-propane sulfonate (CHAPSO).

In more than one embodiment of the above assay methods of the invention, it may be desirable to immobilize either NOVX protein or its target molecule to facilitate separation of complexed from uncomplexed forms of one or both of the proteins, as well as to accommodate automation of the assay. Binding of a test compound to NOVX protein, or interaction of NOVX protein with a target molecule in the presence and absence of a candidate compound, can be accomplished in any vessel suitable for containing the reactants. Examples of such vessels include microtiter plates, test tubes, and micro-centrifuge tubes. In one embodiment, a fusion protein can be provided that adds a domain that allows one or both of the proteins to be bound to a matrix. For example, GST-NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of NOVX protein binding or activity determined using standard techniques.

Other techniques for immobilizing proteins on matrices can also be used in the screening assays of the invention. For example, either the NOVX protein or its target molecule can be immobilized utilizing conjugation of biotin and streptavidin. Biotinylated NOVX protein or target molecules can be prepared from biotin-NHS (N-hydroxy-succinimide) using techniques well-known within the art (e.g. biotinylation kit, Pierce Chemicals, Rockford, Ill.), and immobilized in the wells of streptavidin-coated 96 well plates (Pierce Chemical). Alternatively, antibodies reactive with NOVX protein or target molecules, but which do not interfere with binding of the NOVX protein to its target molecule, can be derivatized to the wells of the plate, and unbound target or NOVX protein trapped in the wells by antibody conjugation. Methods for detecting such complexes, in addition to those described above for the GST-immobilized complexes, include immunodetection of complexes using antibodies reactive with the NOVX protein or target molecule, as well as enzyme-linked assays that rely on detecting an enzymatic activity associated with the NOVX protein or target molecule.

In another embodiment, modulators of NOVX protein expression are identified in a method wherein a cell is contacted with a candidate compound and the expression of NOVX mRNA or protein in the cell is determined. The level of expression of NOVX mRNA or protein in the presence of the candidate compound is compared to the level of expression of NOVX mRNA or protein in the absence of the candidate compound. The candidate compound can then be identified as a modulator of NOVX mRNA or protein expression based upon this comparison. For example, when expression of NOVX mRNA or protein is greater (i.e., statistically significantly greater) in the presence of the candidate compound than in its absence, the candidate compound is identified as a stimulator of NOVX mRNA or protein expression. Alternatively, when expression of NOVX mRNA or protein is less (statistically significantly less) in the presence of the candidate compound than in its absence, the candidate compound is identified as an inhibitor of NOVX mRNA or protein expression. The level of NOVX mRNA or protein expression in the cells can be determined by methods described herein for detecting NOVX mRNA or protein.

In yet another aspect of the invention, the NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Chem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with NOVX ("NOVX-binding proteins" or "NOVX-bp") and modulate NOVX activity. Such NOVX-binding proteins are also likely to be involved in the propagation of signals by the NOVX proteins as, for example, upstream or downstream elements of the NOVX pathway.

The two-hybrid system is based on the modular nature of most transcription factors, which consist of separable DNA-binding and activation domains. Briefly, the assay utilizes two different DNA constructs. In one construct, the gene that codes for NOVX is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the NOVX sequences, SEQ ID NOS:1, 3, 5, 7, 9, 11, 13, 15, 17, 19, 21, 23, 25, 27, 29, 31, 33, 34, 35, 37, 39, 41, 43, 45, 47 and 49, or fragments or derivatives thereof, can be used to map the location of the NOVX genes, respectively, on a chromosome. The mapping of the NOVX sequences to chromosomes is an important-first step in correlating these sequences with genes associated with disease.

Briefly, NOVX genes can be mapped to chromosomes by preparing PCR primers (preferably 15–25 bp in length) from the NOVX sequences. Computer analysis of the NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a fall set of mouse chromosomes, allowing easy mapping of individual genes to specific human chromosomes. See, e.g., D'Eustachio, et al., 1983. *Science* 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the NOVX sequences to design oligonucleotide primers, sub-localization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results at a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. Such data are found, e.g., in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g., Egeland, et al., 1987. *Nature,* 325: 783–787.

Moreover, differences in the DNA sequences between individuals affected and unaffected with a disease associated with the NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP ("restriction fragment length polymorphisms," described in U.S. Pat. No. 5,272,057).

Furthermore, the sequences of the invention can be used to provide an alternative technique that determines the actual base-by-base DNA sequence of selected portions of an individual's genome. Thus, the NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS:1, 3, 5, 7, 9, 11, 13, 15, 17, 19, 21, 23, 25, 27, 29, 31, 33, 34, 35, 37, 39, 41, 43, 45, 47 and 49 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining NOVX protein and/or nucleic acid expression as well as NOVX activity, in the context of a biological sample (e.g., blood, serum, cells, tissue) to thereby determine whether an individual is afflicted with a disease or disorder, or is at risk of developing a disorder, associated with aberrant NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers. The invention also provides for prognostic (or predictive) assays for determining whether an individual is at risk of developing a disorder associated with NOVX protein, nucleic acid expression or activity. For example, mutations in an NOVX gene can be assayed in a biological sample. Such assays can be used for prognostic or predictive purpose to thereby prophylactically treat an individual prior to the onset of a disorder characterized by or associated with NOVX protein, nucleic acid expression, or biological activity.

Another aspect of the invention provides methods for determining NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.)

Yet another aspect of the invention pertains to monitoring the influence of agents (e.g., drugs, compounds) on the expression or activity of NOVX in clinical trials.

These and other agents are described in further detail in the following sections.

Diagnostic Assays

An exemplary method for detecting the presence or absence of NOVX in a biological sample involves obtaining a biological sample from a test subject and contacting the biological sample with a compound or an agent capable of detecting NOVX protein or nucleic acid (e.g., mRNA, genomic DNA) that encodes NOVX protein such that the presence of NOVX is detected in the biological sample. An agent for detecting NOVX mRNA or genomic DNA is a labeled nucleic acid probe capable of hybridizing to NOVX mRNA or genomic DNA. The nucleic acid probe can be, for example, a full-length NOVX nucleic acid, such as the nucleic acid of SEQ ID NOS:1, 3, 5, 7, 9, 11, 13, 15, 17, 19, 21, 23, 25, 27, 29, 31, 33, 34, 35, 37, 39, 41, 43, 45, 47 and 49, or a portion thereof, such as an oligonucleotide of at least 15, 30, 50, 100, 250 or 500 nucleotides in length and sufficient to specifically hybridize under stringent conditions to NOVX mRNA or genomic DNA. Other suitable probes for use in the diagnostic assays of the invention are described herein.

An agent for detecting NOVX protein is an antibody capable of binding to NOVX protein, preferably an antibody with a detectable label. Antibodies can be polyclonal, or more preferably, monoclonal. An intact antibody, or a fragment thereof (e.g., Fab or $F(ab')_2$) can be used. The term “labeled”, with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term “biological sample” is intended to include tissues, cells and biological fluids isolated from a subject, as well as tissues, cells and fluids present within a subject. That is, the detection method of the invention can be used to detect NOVX mRNA, protein, or genomic DNA in a biological sample in vitro as well as in vivo. For example, in vitro techniques for detection of NOVX mRNA include Northern hybridizations and in situ hybridizations. In vitro techniques for detection of NOVX protein include enzyme linked immunosorbent assays (ELISAs), Western blots, immunoprecipitations, and immunofluorescence. In vitro techniques for detection of NOVX genomic DNA include Southern hybridizations. Furthermore, in vivo techniques for detection of NOVX protein include introducing into a subject a labeled anti-NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting NOVX protein, mRNA, or genomic DNA, such that the presence of NOVX protein, mRNA or genomic DNA is detected in the biological sample, and comparing the presence of NOVX protein, mRNA or genomic DNA in the control sample with the presence of NOVX protein, mRNA or genomic DNA in the test sample.

The invention also encompasses kits for detecting the presence of NOVX in a biological sample. For example, the kit can comprise: a labeled compound or agent capable of detecting NOVX protein or mRNA in a biological sample; means for determining the amount of NOVX in the sample; and means for comparing the amount of NOVX in the sample with a standard. The compound or agent can be packaged in a suitable container. The kit can further comprise instructions for using the kit to detect NOVX protein or nucleic acid.

Prognostic Assays

The diagnostic methods described herein can furthermore be utilized to identify subjects having or at risk of developing a disease or disorder associated with aberrant NOVX expression or activity. For example, the assays described herein, such as the preceding diagnostic assays or the following assays, can be utilized to identify a subject having or at risk of developing a disorder associated with NOVX protein, nucleic acid expression or activity. Alternatively, the prognostic assays can be utilized to identify a subject having or at risk for developing a disease or disorder. Thus, the invention provides a method for identifying a disease or disorder associated with aberrant NOVX expression or activity in which a test sample is obtained from a subject and NOVX protein or nucleic acid (e.g. mRNA, genomic DNA) is detected, wherein the presence of NOVX protein or nucleic acid is diagnostic for a subject having or at risk of developing a disease or disorder associated with aberrant NOVX expression or activity. As used herein, a “test sample” refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant NOVX expression or activity. For example, such methods can be used to determine whether a subject can be effectively treated with an agent for a disorder. Thus, the invention provides methods for determining whether a subject can be effectively treated with an agent for a disorder associated with aberrant NOVX expression or activity in which a test sample is obtained and NOVX protein or nucleic acid is detected (e.g., wherein the presence of NOVX protein or nucleic acid is diagnostic for a subject that can be administered the agent to treat a disorder associated with aberrant NOVX expression or activity).

The methods of the invention can also be used to detect genetic lesions in an NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an NOVX-protein, or the misexpression of the NOVX gene. For example, such genetic lesions can be detected by ascertaining the existence of at least one of: (i) a deletion of one or more nucleotides from an NOVX gene; (ii) an addition of one or more nucleotides to an NOVX gene; (iii) a substitution of one or more nucleotides of an NOVX gene, (iv) a chromosomal rearrangement of an NOVX gene; (v) an alteration in the level of a messenger RNA transcript of an NOVX gene, (vi) aberrant modification of an NOVX gene, such as of the methylation pattern of the genomic DNA, (vii) the presence of a non-wild-type splicing pattern of a messenger RNA transcript of an NOVX gene, (viii) a non-wild-type level of an NOVX protein, (ix) allelic loss of an NOVX gene, and (x) inappropriate post-translational modification of an NOVX protein. As described herein, there are a large number of assay techniques known in the art which can be used for detecting lesions in an NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Science* 241:1077–1080; and Nakazawa, et al., 1994. *Proc. Natl. Acad. Sci. USA* 91: 360–364), the latter of which can be particularly useful for detecting point mutations in the NOVX-gene (see, Abravaya, et al., 1995. *Nucl. Acids Res.* 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an NOVX gene under conditions such that hybridization and amplification of the NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); Qβ Replicase (see, Lizardi, et al, 1988. *BioTechnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,493,531) can be used to score for the presence of specific mutations by development or loss of a ribozyme cleavage site.

In other embodiments, genetic mutations in NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the NOVX gene and detect mutations by comparing the sequence of the sample NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the NOVX gene include methods in which protection from cleavage agents is used to detect mismatched bases in RNA/RNA or RNA/DNA heteroduplexes. See, e.g., Myers, et al., 1985. *Science* 230: 1242. In general, the art technique of "mismatch cleavage" starts by providing heteroduplexes of formed by hybridizing (labeled) RNA or DNA containing the wild-type NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with $S_1$ nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al., 1988. *Proc. Natl. Acad. Sci. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an NOVX sequence, e.g., a wild-type NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766; Cotton, 1993. *Mutat. Res.* 285: 125–144; Hayashi, 1992. *Genet. Anal. Tech. Appl.* 9: 73–79. Single-stranded DNA fragments of sample and control NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See, e.g. Keen, et al., 1991. *Trends Genet.* 7: 5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g., Rosenbaum and Reissner, 1987. *Biophys. Chem.* 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that permit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes* 6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an NOVX gene.

Furthermore, any cell type or tissue, preferably peripheral blood leukocytes, in which NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on NOVX activity (e.g., NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of NOVX protein, expression of NOVX nucleic acid, or mutation content of NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See e.g., Eichelbaum, 1996. *Clin. Exp. Pharmacol. Physiol.,* 23: 983–985; Linder, 1997. *Clin. Chem.,* 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of NOVX protein, expression of NOVX nucleic acid, or mutation content of NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an NOVX modulator, such as a modulator identified by one of the exemplary screening assays described herein.

Monitoring of Effects During Clinical Trials

Monitoring the influence of agents (e.g., drugs, compounds) on the expression or activity of NOVX (e.g., the ability to modulate aberrant cell proliferation and/or differentiation) can be applied not only in basic drug screening, but also in clinical trials. For example, the effectiveness of an agent determined by a screening assay as described herein to increase NOVX gene expression, protein levels, or upregulate NOVX activity, can be monitored in clinical trails of subjects exhibiting decreased NOVX gene expression, protein levels, or downregulated NOVX activity. Alternatively, the effectiveness of an agent determined by a screening assay to decrease NOVX gene expression, protein levels, or downregulate NOVX activity, can be monitored in clinical trails of subjects exhibiting increased NOVX gene expression, protein levels, or upregulated NOVX activity. In such clinical trials, the expression or activity of NOVX and, preferably, other genes that have been implicated in, for example, a cellular proliferation or immune disorder can be used as a "read out" or markers of the immune responsiveness of a particular cell.

By way of example, and not of limitation, genes, including NOVX, that are modulated in cells by treatment with an agent (e.g., compound, drug or small molecule) that modulates NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an NOVX protein, mRNA, or genomic DNA in the preadministration sample; (iii) obtaining one or more post-administration samples from the subject; (iv) detecting the level of expression or activity of the NOVX protein, mRNA, or genomic DNA in the post-administration samples; (v) comparing the level of expression or activity of the NOVX protein, mRNA, or genomic DNA in the pre-administration sample with the NOVX protein, mRNA, or genomic DNA in the post administration sample or samples; and (vi) altering the administration of the agent to the subject accordingly. For example, increased administration of the agent may be desirable to increase the expression or activity of NOVX to higher levels than detected, i.e., to increase the effectiveness of the agent. Alternatively, decreased administration of the agent may be desirable to decrease expression or activity of NOVX to lower levels than detected, i.e., to decrease the effectiveness of the agent.

Methods of Treatment

The invention provides for both prophylactic and therapeutic methods of treating a subject at risk of (or susceptible to) a disorder or having a disorder associated with aberrant NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Ostoeodystrophy, and other diseases, disorders and conditions of the like.

These methods of treatment will be discussed more fully, below.

Disease and Disorders

Diseases and disorders that are characterized by increased (relative to a subject not suffering from the disease or disorder) levels or biological activity may be treated with Therapeutics that antagonize (i.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof; (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, e.g., Capecchi, 1989. *Science* 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity. Therapeutics that upregulate activity may be administered in a therapeutic or prophylactic manner. Therapeutics that may be utilized include, but are not limited to, an aforementioned peptide, or analogs, derivatives, fragments or homologs thereof; or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that are well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g. Northern assays, dot blots, in situ hybridization, and the like).

Prophylactic Methods

In one aspect, the invention provides a method for preventing, in a subject, a disease or condition associated with an aberrant NOVX expression or activity, by administering to the subject an agent that modulates NOVX expression or at least one NOVX activity. Subjects at risk for a disease that is caused or contributed to by aberrant NOVX expression or activity can be identified by, for example, any or a combination of diagnostic or prognostic assays as described herein. Administration of a prophylactic agent can occur prior to the manifestation of symptoms characteristic of the NOVX aberrancy, such that a disease or disorder is prevented or, alternatively, delayed in its progression. Depending upon the type of NOVX aberrancy, for example, an NOVX agonist or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating NOVX expression or activity for therapeutic purposes. The modulatory method of the invention involves contacting a cell with an agent that modulates one or more of the activities of NOVX protein activity associated with the cell. An agent that modulates NOVX protein activity can be an agent as described herein, such as a nucleic acid or a protein, a naturally-occurring cognate ligand of an NOVX protein, a peptide, an NOVX peptidomimetic, or other small molecule. In one embodiment, the agent stimulates one or more NOVX protein activity. Examples of such stimulatory agents include active NOVX protein and a nucleic acid molecule encoding NOVX that has been introduced into the cell. In another embodiment, the agent inhibits one or more NOVX protein activity. Examples of such inhibitory agents include antisense NOVX nucleic acid molecules and anti-NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an NOVX protein or nucleic acid molecule. In one embodiment, the method involves administering an agent (e.g., an agent identified by a screening assay described herein), or combination of agents that modulates (e.g., up-regulates or down-regulates) NOVX expression or activity. In another embodiment, the method involves administering an NOVX protein or nucleic acid molecule as therapy to compensate for reduced or aberrant NOVX expression or activity.

Stimulation of NOVX activity is desirable in situations in which NOVX is abnormally downregulated and/or in which increased NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoietic disorders, and the various dyslipidemias, metabolic disturbances associated with obesity, the metabolic syndrome X and wasting disorders associated with chronic diseases and various cancers.

As an example, a cDNA encoding the NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the NOVX protein, and the NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Identification of NOVX Nucleic Acids

TblastN using CuraGen Corporation's sequence file for polypeptides or homologs was run against the Genomic Daily Files made available by GenBank or from files downloaded from the individual sequencing centers. Exons were predicted by homology and the intron/exon boundaries were determined using standard genetic rules. Exons were further selected and refined by means of similarity determination using multiple BLAST (for example, tBlastN, BlastX, and BlastN) searches, and, in some instances, GeneScan and Grail. Expressed sequences from both public and proprietary databases were also added when available to further define and complete the gene sequence. The DNA sequence was then manually corrected for apparent inconsistencies thereby obtaining the sequences encoding the full-length protein.

The novel NOVX target sequences identified in the present invention were subjected to the exon linking process to confirm the sequence. PCR primers were designed by starting at the most upstream sequence available, for the forward primer, and at the most downstream sequence available for the reverse primer. PCR primer sequences were used for obtaining different clones. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

Physical clone: Exons were predicted by homology and the intron/exon boundaries were determined using standard genetic rules. Exons were further selected and refined by means of similarity determination using multiple BLAST (for example, tBlastN, BlastX, and BlastN) searches, and, in some instances, GeneScan and Grail. Expressed sequences from both public and proprietary databases were also added when available to further define and complete the gene sequence. The DNA sequence was then manually corrected for apparent inconsistencies thereby obtaining the sequences encoding the full-length protein.

Example 2

Identification of Single Nucleotide Polymorphisms in NOVX Nucleic Acid Sequences Variant sequences are also included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, when a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern. Examples include alteration in temporal expression, physiological response regulation, cell type expression regulation, intensity of expression, and stability of transcribed message.

SeqCalling assemblies produced by the exon linking process were selected and extended using the following criteria. Genomic clones having regions with 98% identity to all or part of the initial or extended sequence were identified by BLASTN searches using the relevant sequence to query human genomic databases. The genomic clones that resulted were selected for further analysis because this identity indicates that these clones contain the genomic locus for these SeqCalling assemblies. These sequences were analyzed for putative coding regions as well as for similarity to the known DNA and protein sequences. Programs used for these analyses include Grail, Genscan, BLAST, HMMER, FASTA, Hybrid and other relevant programs.

Some additional genomic regions may have also been identified because selected SeqCalling assemblies map to those regions. Such SeqCalling sequences may have overlapped with regions defined by homology or exon prediction. They may also be included because the location of the fragment was in the vicinity of genomic regions identified by similarity or exon prediction that had been included in the original predicted sequence. The sequence so identified was manually assembled and then may have been extended using one or more additional sequences taken from CuraGen Corporation's human SeqCalling database. SeqCalling fragments suitable for inclusion were identified by the CuraTools™ program SeqExtend or by identifying SeqCalling fragments mapping to the appropriate regions of the genomic clones analyzed.

The regions defined by the procedures described above were then manually integrated and corrected for apparent inconsistencies that may have arisen, for example, from miscalled bases in the original fragments or from discrepancies between predicted exon junctions, EST locations and regions of sequence similarity, to derive the final sequence disclosed herein. When necessary, the process to identify and analyze SeqCalling assemblies and genomic clones was reiterated to derive the full length sequence (Alderborn et al., Determination of Single Nucleotide Polymorphisms by Real-time Pyrophosphate DNA Sequencing. Genome Research. 10 (8) 1249–1265, 2000).

Example 3

Quantitative Expression Analysis of Clones in Various Cells and Tissues

The quantitative expression of various clones was assessed using microtiter plates containing RNA samples from a variety of normal and pathology-derived cells, cell lines and tissues using real time quantitative PCR (RTQ PCR). RTQ PCR was performed on an Applied Biosystems ABI PRISMS® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and cells related to inflammatory conditions), Panel 5D/5I (containing human tissues and cell lines with an emphasis on metabolic diseases), AI_comprehensive_panel (containing normal tissue and samples from autoimmune diseases), Panel CNSD.01 (containing central nervous system samples from normal and diseased brains) and CNS_neurodegeneration_panel (containing samples from normal and Alzheimer's diseased brains).

RNA integrity from all samples is controlled for quality by visual assessment of agarose gel electropherograms using 28S and 18S ribosomal RNA staining intensity ratio as a guide (2:1 to 2.5:1 28s:18s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, β-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript II (Invitrogen Corporation; Catalog No. 18064-147) and random hexamers according to the manufacturer's instructions. Reactions containing up to 10 μg of total RNA were performed in a volume of 20 μl and incubated for 60 minutes at 42° C. This reaction can be scaled up to 50 μg of total RNA in a final volume of 100 μl. sscDNA samples are then normalized to reference nucleic acids as described previously, using 1× TaqMans® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosystems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1× TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 1.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:

ca.=carcinoma,
*=established from metastasis,
met=metastasis,
s cell var=small cell variant,
non-s=non-sm=non-small,
squam=squamous,
pl. eff=pl effusion=pleural effusion,
glio=glioma,
astro=astrocytoma, and
neuro=neuroblastoma.

General_screening_panel_v1.4

The plates for Panel 1.4 include 2 control wells (genomic DNA control and chemistry control) and 94 wells containing cDNA from various samples. The samples in Panel 1.4 are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 1.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHTN) or the National Disease Research Initiative (NDRI). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDRI or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4.1D) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDRI) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 5–10 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 μM non essential amino acids (Gibco/Life Technologies, Rockville, Md.), 1 mM sodium pyruvate (Gibco), mercaptoethanol $5.5\times10^{-5}$M (Gibco), and 10 mM Hepes (Gibco) and Interleukin 2 for 4–6 days. Cells were then either activated with 10–20 ng/ml PMA and 1–2 μg/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) with PHA (phytohemagglutinin) or PWM (pokeweed mitogen) at approximately 5 μg/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2\times10^{6}$ cells/ml in DMEM 5% FCS (Hyclone), 100 μM non essential amino acids (Gibco), 1 mM sodium pyruvate (Gibco), mercaptoethanol ($5.5\times10^{-5}$M) (Gibco), and 10 mM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, Utah), 100 μM non essential amino acids (Gibco), 1 mM sodium pyruvate (Gibco), mercaptoethanol $5.5\times10^{-5}$M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 μg/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD14 and CD19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) and plated at $10^{6}$ cells/ml onto Falcon 6 well tissue culture plates that had been coated overnight with 0.5 μg/ml anti-CD28 (Pharmingen) and 3 ug/ml anti-CD3 (OKT3, ATCC) in PBS. After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) and IL-2 for 4–6 days before RNA was prepared.

To obtain B cells, tonsils were procured from NDRI. The tonsil was cut up with sterile dissecting scissors and then passed through a sieve. Tonsil cells were then spun down and resupended at $10^{6}$ cells/ml in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco). To activate the cells, we used PWM at 5 μg/ml or anti-CD40 (Pharmingen) at approximately 10 μg/ml and IL-4 at 5–10 ng/ml. Cells were harvested for RNA preparation at 24, 48 and 72 hours.

To prepare the primary and secondary Th1/Th2 and Tr1 cells, six-well Falcon plates were coated overnight with 10 μg/ml anti-CD28 (Pharmingen) and 2 μg/ml OKT3 (ATCC), and then washed twice with PBS. Umbilical cord blood CD4 lymphocytes (Poietic Systems, German Town, Md.) were cultured at $10^{5}$–$10^{6}$ cells/ml in DMEM 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco) and IL-2 (4 ng/ml). IL-12 (5 ng/ml) and anti-IL4 (1 μg/ml) were used to direct to Th1, while IL-4 (5 ng/ml) and anti-IFN gamma (1 μg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco) and IL-2 (1 ng/ml). Following this, the activated Th1, Th2 and Tr1 lymphocytes were re-stimulated for 5 days with anti-CD28/OKT3 and cytokines as described above, but with the addition of anti-CD95L (1 μg/ml) to prevent apoptosis. After 4–5 days, the Th1, Th2 and Tr1 lymphocytes were washed and then expanded again with IL-2 for 4–7 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5\times10^{5}$ cells/ml for 8 days, changing the media every 3 days and adjusting the cell concentration to $5\times10^{5}$ cells/ml. For the culture of these cells, we used DMEM or RPMI (as recommended by the ATCC), with the addition of 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco). RNA was either prepared from resting cells or cells activated with PMA at 10 ng/ml and ionomycin at 1 μg/ml for 6 and 14 hours. Keratinocyte line CCD106 and an airway epithelial tumor line NCI-H292 were also obtained from the ATCC. Both were cultured in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^{7}$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at −20° C. overnight. The precipitated RNA was spun down at 9,000 rpm for 15 min in a Sorvall SS34 rotor and washed in 70% ethanol. The pellet was redissolved in 300 μl of RNAse-free water and 35 μl buffer (Promega) 5 μl DTT, 7 μl RNAsin and 8 μl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at −80° C.

AI_comprehensive Panel_v1.0

The plates for AI_comprehensive panel_v1.0 include two control wells and 89 test samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-1 anti-trypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v1.0 panel, the following abbreviations are used:

AI=Autoimmunity
Syn=Synovial
Normal=No apparent disease
Rep22/Rep20=individual patients
RA=Rheumatoid arthritis
Backus=From Backus Hospital
OA=Osteoarthritis
(SS) (BA) (MF)=Individual patients
Adj=Adjacent tissue
Match control=adjacent tissues
M=Male
F=Female
COPD=Chronic obstructive pulmonary disease Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Caesarean section. After delivery of the infant, when the surgical incisions were being repaired/closed, the obstetrician removed a small sample (<1 cc) of the exposed metabolic tissues during the closure of each surgical level. The biopsy material was rinsed in sterile saline, blotted and fast frozen within 5 minutes from the time of removal. The tissue was then flash frozen in liquid nitrogen and stored, individually, in sterile screw-top tubes and kept on dry ice for shipment to or to be picked up by CuraGen. The metabolic tissues of interest include uterine wall (smooth muscle), visceral adipose, skeletal muscle (rectus) and subcutaneous adipose. Patient descriptions are as follows:

Patient 2: Diabetic Hispanic, overweight, not on insulin
Patient 7–9: Nondiabetic Caucasian and obese (BMI>30)
Patient 10: Diabetic Hispanic, overweight, on insulin
Patient 11: Nondiabetic African American and overweight
Patient 12: Diabetic Hispanic on insulin Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2, 1999: 143–147. Clonetics provided Trizol lysates or frozen pellets suitable for mRNA isolation and ds cDNA production. A general description of each donor is as follows:

Donor 2 and 3 U: Mesenchymal Stem cells, Undifferentiated Adipose
Donor 2 and 3 AM: Adipose, Adipose Midway Differentiated
Donor 2 and 3 AD: Adipose, Adipose Differentiated Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5I contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5I.

In the labels employed to identify tissues in the SD and 5I panels, the following abbreviations are used:

GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells Panel CNSD.01

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supernuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:

PSP=Progressive supranuclear palsy

Sub Nigra=Substantia nigra

Glob Palladus=Globus palladus

Temp Pole=Temporal pole

Cing Gyr=Cingulate gyrus

BA 4=Brodman Area 4

Panel CNS_Neurodegeneration_V1.0

The plates for Panel CNS_Neurodegeneration_V1.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD) patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the parietal cortex shows moderate neuronal death in the late stages of the disease; the occipital cortex is spared in AD and therefore acts as a "control" region within AD patients. Not all brain regions are represented in all cases.

In the labels employed to identify tissues in the CNS_Neurodegeneration_V1.0 panel, the following abbreviations are used:

AD=Alzheimer's disease brain; patient was demented and showed AD-like pathology upon autopsy Control=Control brains; patient not demented, showing no neuropathology Control (Path)=Control brains; pateint not demented but showing sever AD-like pathology SupTemporal Ctx=Superior Temporal Cortex Inf Temporal Ctx=Inferior Temporal Cortex A. NOV1: TEN-M4-like Expression of the NOV1 gene (CG56091-01) was assessed using the primer-probe sets Ag2581, Ag2910 and Ag1479, described in Tables 20–22. Results of the RTQ-PCR runs are shown in Tables 23–27.

TABLE 20

Probe Name Ag2581

| Primers | Sequences | | Length | Start Position |
|---|---|---|---|---|
| Forward | 5'-tgaccacagacatcatcagtgt-3' | (SEQ ID NO:190) | 22 | 7821 |
| Probe | TET-5'-ccatcttgaaccatgcccactaccta-3'-TAMRA | (SEQ ID NO:191) | 26 | 7872 |
| Reverse | 5'-tcaatggtgaagtgcaggtt-3' | (SEQ ID NO:192) | 20 | 7901 |

TABLE 21

Probe Name Ag2910

| Primers | Sequences | | Length | Start Position |
|---|---|---|---|---|
| Forward | 5'-tgaccacagacatcatcagtgt-3' | (SEQ ID NO:193) | 22 | 7821 |
| Probe | TET-5'-ccatcttgaaccatgcccactaccta-3'-TAMRA | (SEQ ID NO:194) | 26 | 7872 |
| Reverse | 5'-tcaatggtgaagtgcaggtt-3' | (SEQ ID NO:195) | 20 | 7901 |

TABLE 22

Probe Name Ag1479

| Primers | Sequences | | Length | Start Position |
|---|---|---|---|---|
| Forward | 5'-cacggaacgtatcttcaagaaa-3' | (SEQ ID NO:196) | 22 | 2108 |
| Probe | TET-5'-ctgcacgtgtgaccctaactggactg-3'-TAMRA | (SEQ ID NO:197) | 26 | 2137 |
| Reverse | 5'-gccacagtccacagaacatatt-3' | (SEQ ID NO:198) | 22 | 2182 |

TABLE 23

CNS_neurodegeneration_v1.0

| Tissue Name | Rel. Exp. (%) Ag2581, Run 208777162 | Rel. Exp. (%) Ag2910, Run 209735201 | Tissue Name | Rel. Exp. (%) Ag2581, Run 208777162 | Rel. Exp. (%) Ag2910, Run 209735201 |
|---|---|---|---|---|---|
| AD 1 Hippo | 8.8 | 11.0 | Control (Path) 3 Temporal Ctx | 1.5 | 2.1 |
| AD 2 Hippo | 28.5 | 26.4 | Control (Path) 4 Temporal Ctx | 27.7 | 25.2 |
| AD 3 Hippo | 5.3 | 6.1 | AD 1 Occipital Ctx | 13.4 | 13.2 |
| AD 4 Hippo | 8.5 | 7.1 | AD 2 Occipital Ctx (Missing) | 0.0 | 0.0 |
| AD 5 Hippo | 94.0 | 100.0 | AD 3 Occipital Ctx | 1.7 | 3.7 |
| AD 6 Hippo | 67.8 | 66.9 | AD 4 Occipital Ctx | 31.0 | 14.3 |
| Control 2 Hippo | 42.6 | 45.1 | AD 5 Occipital Ctx | 57.0 | 55.9 |
| Control 4 Hippo | 9.7 | 11.0 | AD 6 Occipital Ctx | 16.2 | 15.8 |
| Control (Path) 3 Hippo | 3.8 | 2.6 | Control 1 Occipital Ctx | 1.4 | 1.0 |
| AD 1 Temporal Ctx | 9.3 | 11.8 | Control 2 Occipital Ctx | 72.7 | 69.7 |
| AD 2 Temporal Ctx | 26.8 | 27.0 | Control 3 Occipital Ctx | 16.0 | 13.2 |
| AD 3 Temporal Ctx | 5.0 | 4.0 | Control 4 Occipital Ctx | 5.4 | 6.8 |
| AD 4 Temporal Ctx | 22.8 | 24.1 | Control (Path) 1 Occipital Ctx | 93.3 | 95.9 |
| AD 5 Inf Temporal Ctx | 100.0 | 94.6 | Control (Path) 2 Occipital Ctx | 8.6 | 9.4 |
| AD 5 Sup Temporal Ctx | 34.2 | 36.9 | Control (Path) 3 Occipital Ctx | 0.9 | 1.1 |
| AD 6 Inf Temporal Ctx | 47.3 | 53.2 | Control (Path) 4 Occipital Ctx | 17.1 | 15.2 |
| AD 6 Sup Temporal Ctx | 47.6 | 40.9 | Control 1 Parietal Ctx | 2.1 | 5.1 |
| Control 1 Temporal Ctx | 2.4 | 1.9 | Control 2 Parietal Ctx | 35.6 | 44.4 |
| Control 2 Temporal Ctx | 44.8 | 44.8 | Control 3 Parietal Ctx | 17.8 | 14.6 |
| Control 3 Temporal Ctx | 10.4 | 11.1 | Control (Path) 1 Parietal Ctx | 78.5 | 74.2 |
| Control 3 Temporal Ctx | 8.2 | 7.5 | Control (Path) 2 Parietal Ctx | 19.5 | 21.8 |
| Control (Path) 1 Temporal Ctx | 80.1 | 68.3 | Control (Path) 3 Parietal Ctx | 1.1 | 2.0 |
| Control (Path) 2 Temporal Ctx | 36.6 | 29.3 | Control (Path) 4 Parietal Ctx | 43.2 | 37.9 |

TABLE 24

Panel 1.3D

| Tissue Name | Rel. Exp.(%) Ag1479, Run 165520101 | Rel. Exp.(%) Ag2581, Run 162292620 | Rel. Exp.(%) Ag2910, Run 162556486 | Tissue Name | Rel. Exp.(%) Ag1479, Run 165520101 | Rel. Exp.(%) Ag2581, Run 162292620 | Rel. Exp.(%) Ag2910, Run 162556486 |
|---|---|---|---|---|---|---|---|
| Liver adenocarcinoma | 16.0 | 0.0 | 0.0 | Kidney (fetal) | 2.8 | 5.8 | 4.7 |
| Pancreas | 0.5 | 0.2 | 0.0 | Renal ca. 786-0 | 11.2 | 1.7 | 0.1 |
| Pancreatic ca. CAPAN 2 | 16.2 | 0.5 | 0.0 | Renal ca. A498 | 13.1 | 0.8 | 0.9 |
| Adrenal gland | 4.1 | 0.3 | 0.4 | Renal ca. RXF 393 | 21.5 | 8.8 | 4.7 |
| Thyroid | 2.0 | 5.4 | 5.3 | Renal ca. ACHN | 10.1 | 4.0 | 5.0 |
| Salivary gland | 0.2 | 0.5 | 0.7 | Renal ca. UO-31 | 10.2 | 13.7 | 13.9 |
| Pituitary gland | 3.5 | 11.1 | 8.1 | Renal ca. TK-10 | 0.0 | 2.9 | 3.0 |
| Brain (fetal) | 8.7 | 6.6 | 11.7 | Liver | 0.0 | 0.0 | 0.0 |
| Brain (whole) | 10.4 | 10.9 | 7.2 | Liver (fetal) | 0.1 | 0.0 | 0.0 |
| Brain (amygdala) | 12.8 | 14.9 | 12.9 | Liver ca. (hepatoblast) HepG2 | 0.2 | 0.4 | 0.0 |
| Brain (cerebellum) | 10.0 | 2.6 | 2.0 | Lung | 0.4 | 0.7 | 0.2 |
| Brain (hippocampus) | 17.7 | 13.5 | 12.3 | Lung (fetal) | 0.3 | 0.7 | 1.9 |
| Brain (substantia nigra) | 1.8 | 1.5 | 0.7 | Lung ca. (small cell) LX-1 | 0.0 | 0.0 | 0.0 |
| Brain (thalamus) | 19.3 | 12.2 | 7.3 | Lung ca. (small cell) NCI-H69 | 3.1 | 13.8 | 9.9 |
| Cerebral Cortex | 8.0 | 100.0 | 68.8 | Lung ca. (s.cell var.) SHP-77 | 2.4 | 1.7 | 2.2 |
| Spinal cord | 1.4 | 13.0 | 10.2 | Lung ca. (large cell)NCI-H460 | 18.6 | 0.0 | 0.0 |
| glio/astro U87-MG | 13.6 | 14.5 | 15.5 | Lung ca. (non-sm. cell) A549 | 0.4 | 0.0 | 0.0 |
| glio/astro U-118-MG | 82.4 | 0.2 | 0.2 | Lung ca. (non-s.cell) NCI-H23 | 1.4 | 0.3 | 0.0 |
| astrocytoma SW1783 | 27.9 | 2.4 | 2.8 | Lung ca. (non-s.cell) HOP-62 | 9.5 | 0.1 | 0.6 |
| neuro*; met SK-N-AS | 31.2 | 4.0 | 3.8 | Lung ca. (non-s.cl) NCI-H522 | 28.1 | 0.0 | 0.0 |
| astrocytoma SF-539 | 25.2 | 0.2 | 0.0 | Lung ca. (squam.) SW 900 | 0.6 | 2.2 | 2.8 |
| astrocytoma SNB-75 | 20.6 | 0.8 | 2.5 | Lung ca. (squam.) NCI-H596 | 16.5 | 6.0 | 4.6 |
| glioma SNB-19 | 4.7 | 15.0 | 12.2 | Mammary gland | 0.7 | 1.9 | 2.2 |
| glioma U251 | 100.0 | 5.7 | 5.9 | Breast ca.* (pl.ef) MCF-7 | 5.0 | 0.3 | 1.4 |
| glioma SF-295 | 5.6 | 1.3 | 1.5 | Breast ca.* (pl.ef) MDA-MB-231 | 2.4 | 0.0 | 0.0 |
| Heart (fetal) | 1.0 | 1.3 | 1.2 | Breast ca.* (pl.ef) T47D | 53.6 | 0.0 | 0.0 |
| Heart | 0.7 | 0.5 | 0.5 | Breast ca. BT-549 | 0.0 | 0.2 | 0.0 |
| Skeletal muscle (fetal) | 1.0 | 42.9 | 36.1 | Breast ca. MDA-N | 0.8 | 0.0 | 0.0 |
| Skeletal muscle | 6.0 | 0.8 | 0.6 | Ovary | 0.8 | 100.0 | 100.0 |
| Bone marrow | 0.0 | 0.2 | 0.7 | Ovarian ca. OVCAR-3 | 58.6 | 0.0 | 0.7 |

TABLE 24-continued

Panel 1.3D

| Tissue Name | Rel. Exp.(%) Ag1479, Run 165520101 | Rel. Exp.(%) Ag2581, Run 162292620 | Rel. Exp.(%) Ag2910, Run 162556486 | Tissue Name | Rel. Exp.(%) Ag1479, Run 165520101 | Rel. Exp.(%) Ag2581, Run 162292620 | Rel. Exp.(%) Ag2910, Run 162556486 |
|---|---|---|---|---|---|---|---|
| Thymus | 0.2 | 8.7 | 3.7 | Ovarian ca. OVCAR-4 | 2.4 | 0.0 | 0.0 |
| Spleen | 0.7 | 0.0 | 0.2 | Ovarian ca. OVCAR-5 | 0.0 | 0.8 | 2.6 |
| Lymph node | 2.0 | 0.2 | 0.5 | Ovarian ca. OVCAR-8 | 8.7 | 1.7 | 0.5 |
| Colorectal | 0.3 | 3.0 | 2.0 | Ovarian ca. IGROV-1 | 3.1 | 0.0 | 0.1 |
| Stomach | 3.4 | 0.2 | 0.5 | Ovarian ca.* (ascites) SK-OV-3 | 27.9 | 0.0 | 0.0 |
| Small intestine | 3.5 | 0.0 | 0.1 | Uterus | 2.4 | 1.1 | 1.2 |
| Colon ca. SW480 | 1.6 | 0.0 | 0.0 | Placenta | 8.1 | 0.2 | 0.0 |
| Colon ca.* SW620(SW480 met) | 0.0 | 0.0 | 0.2 | Prostate | 2.1 | 0.2 | 1.0 |
| Colon ca. HT29 | 0.7 | 0.0 | 0.0 | Prostate ca.* (bone met)PC-3 | 0.7 | 27.0 | 19.2 |
| Colon ca. HCT-116 | 0.3 | 0.0 | 0.0 | Testis | 4.5 | 1.9 | 2.5 |
| Colon ca. CaCo-2 | 8.6 | 1.3 | 0.3 | Melanoma Hs688(A).T | 10.0 | 1.6 | 2.2 |
| Colon ca. tissue(ODO3866) | 2.6 | 6.1 | 3.7 | Melanoma* (met) Hs688(B).T | 12.5 | 0.9 | 2.0 |
| Colon ca. HCC-2998 | 1.0 | 0.0 | 0.0 | Melanoma UACC-62 | 1.2 | 0.7 | 0.3 |
| Gastric ca.* (liver met) NCI-N87 | 0.9 | 3.3 | 3.7 | Melanoma M14 | 13.7 | 0.0 | 0.0 |
| Bladder | 0.9 | 1.9 | 2.1 | Melanoma LOX IMVI | 1.2 | 1.3 | 1.4 |
| Trachea | 0.8 | 5.1 | 6.1 | Melanoma* (met) SK-MEL-5 | 3.7 | 0.0 | 0.0 |
| Kidney | 0.8 | 3.7 | 3.0 | Adipose | 3.6 | 2.2 | 1.9 |

TABLE 25

Panel 2D

| Tissue Name | Rel. Exp.(%) Ag2581, Run 161921268 | Rel. Exp.(%) Ag2910, Run 162354453 | Tissue Name | Rel. Exp.(%) Ag2581, Run 161921268 | Rel. Exp.(%) Ag2910, Run 162354453 |
|---|---|---|---|---|---|
| Normal Colon | 13.2 | 7.1 | Kidney Margin 8120608 | 3.8 | 2.6 |
| CC Well to Mod Diff (ODO3866) | 6.5 | 11.0 | Kidney Cancer 8120613 | 0.9 | 0.7 |
| CC Margin (ODO3866) | 2.7 | 2.0 | Kidney Margin 8120614 | 7.5 | 4.4 |
| CC Gr.2 rectosigmoid (ODO3868) | 1.6 | 1.0 | Kidney Cancer 9010320 | 18.4 | 22.4 |
| CC Margin (ODO3868) | 1.0 | 2.1 | Kidney Margin 9010321 | 9.9 | 15.9 |
| CC Mod Diff (ODO3920) | 0.5 | 1.5 | Normal Uterus | 2.4 | 4.9 |
| CC Margin (ODO3920) | 1.4 | 5.0 | Uterus Cancer 064011 | 6.8 | 8.7 |
| CC Gr.2 ascend colon (ODO3921) | 5.3 | 11.6 | Normal Thyroid | 19.1 | 29.5 |
| CC Margin (ODO3921) | 0.9 | 0.3 | Thyroid Cancer 064010 | 52.9 | 75.8 |
| CC from Partial Hepatectomy (ODO4309) Mets | 4.2 | 1.7 | Thyroid Cancer A302152 | 3.9 | 6.7 |

TABLE 25-continued

Panel 2D

| Tissue Name | Rel. Exp.(%) Ag2581, Run 161921268 | Rel. Exp.(%) Ag2910, Run 162354453 | Tissue Name | Rel. Exp.(%) Ag2581, Run 161921268 | Rel. Exp.(%) Ag2910, Run 162354453 |
|---|---|---|---|---|---|
| Liver Margin (ODO4309) | 0.7 | 0.4 | Thyroid Margin A302153 | 31.9 | 35.4 |
| Colon mets to lung (OD04451-01) | 2.9 | 3.1 | Normal Breast | 6.1 | 12.2 |
| Lung Margin (OD04451-02) | 0.8 | 4.2 | Breast Cancer (OD04566) | 4.1 | 4.5 |
| Normal Prostate 6546-1 | 0.7 | 18.7 | Breast Cancer (OD04590-01) | 2.7 | 14.3 |
| Prostate Cancer (OD04410) | 6.8 | 8.8 | Breast Cancer Mets (OD04590-03) | 21.0 | 21.0 |
| Prostate Margin (OD04410) | 3.4 | 5.7 | Breast Cancer Metastasis (OD04655-05) | 3.4 | 5.3 |
| Prostate Cancer (OD04720-01) | 10.3 | 12.7 | Breast Cancer 064006 | 9.7 | 26.2 |
| Prostate Margin (OD04720-02) | 7.4 | 16.2 | Breast Cancer 1024 | 11.3 | 15.3 |
| Normal Lung 061010 | 5.8 | 7.2 | Breast Cancer 9100266 | 4.9 | 12.2 |
| Lung Met to Muscle (ODO4286) | 1.8 | 3.5 | Breast Margin 9100265 | 10.5 | 16.8 |
| Muscle Margin (ODO4286) | 6.8 | 5.8 | Breast Cancer A209073 | 17.0 | 32.3 |
| Lung Malignant Cancer (OD03126) | 20.9 | 19.9 | Breast Margin A2090734 | 6.9 | 8.2 |
| Lung Margin (OD03126) | 4.7 | 4.9 | Normal Liver | 0.0 | 0.3 |
| Lung Cancer (OD04404) | 22.8 | 22.4 | Liver Cancer 064003 | 0.0 | 0.0 |
| Lung Margin (OD04404) | 5.0 | 4.1 | Liver Cancer 1025 | 0.3 | 0.7 |
| Lung Cancer (OD04565) | 13.2 | 14.6 | Liver Cancer 1026 | 0.7 | 0.9 |
| Lung Margin (OD04565) | 0.7 | 0.6 | Liver Cancer 6004-T | 0.3 | 0.9 |
| Lung Cancer (OD04237-01) | 37.6 | 57.8 | Liver Tissue 6004-N | 0.0 | 0.8 |
| Lung Margin (OD04237-02) | 2.4 | 1.3 | Liver Cancer 6005-T | 0.5 | 2.1 |
| Ocular Mel Met to Liver (ODO4310) | 0.0 | 0.3 | Liver Tissue 6005-N | 0.4 | 0.8 |
| Liver Margin (ODO4310) | 0.0 | 0.0 | Normal Bladder | 6.8 | 8.1 |
| Melanoma Mets to Lung (OD04321) | 0.8 | 1.7 | Bladder Cancer 1023 | 6.7 | 8.0 |
| Lung Margin (OD04321) | 1.9 | 4.7 | Bladder Cancer A302173 | 42.3 | 46.3 |
| Normal Kidney | 21.6 | 20.4 | Bladder Cancer (OD04718-01) | 2.8 | 4.2 |
| Kidney Ca, Nuclear grade 2 (OD04338) | 1.9 | 5.0 | Bladder Normal Adjacent (OD04718-03) | 6.0 | 10.2 |
| Kidney Margin (OD04338) | 15.0 | 18.2 | Normal Ovary | 63.7 | 75.3 |
| Kidney Ca Nuclear grade 1/2 (OD04339) | 1.5 | 3.1 | Ovarian Cancer 064008 | 100.0 | 100.0 |
| Kidney Margin (OD04339) | 13.7 | 20.9 | Ovarian Cancer (OD04768-07) | 1.1 | 0.6 |
| Kidney Ca, Clear cell type (OD04340) | 4.0 | 6.5 | Ovary Margin (OD04768-08) | 3.4 | 8.5 |
| Kidney Margin (OD04340) | 8.2 | 13.1 | Normal Stomach | 5.2 | 2.8 |
| Kidney Ca, Nuclear grade 3 (OD04348) | 1.3 | 2.0 | Gastric Cancer 9060358 | 3.4 | 5.6 |
| Kidney Margin (OD04348) | 7.3 | 14.3 | Stomach Margin 9060359 | 2.0 | 2.2 |
| Kidney Cancer (OD04622-01) | 15.4 | 20.0 | Gastric Cancer 9060395 | 8.3 | 17.0 |
| Kidney Margin (OD04622-03) | 1.9 | 4.0 | Stomach Margin 9060394 | 6.2 | 5.2 |

TABLE 25-continued

Panel 2D

| Tissue Name | Rel. Exp.(%) Ag2581, Run 161921268 | Rel. Exp.(%) Ag2910, Run 162354453 | Tissue Name | Rel. Exp.(%) Ag2581, Run 161921268 | Rel. Exp.(%) Ag2910, Run 162354453 |
|---|---|---|---|---|---|
| Kidney Cancer (OD04450-01) | 0.0 | 2.6 | Gastric Cancer 9060397 | 8.2 | 11.6 |
| Kidney Margin (OD04450-03) | 10.5 | 9.5 | Stomach Margin 9060396 | 0.9 | 0.3 |
| Kidney Cancer 8120607 | 9.2 | 15.4 | Gastric Cancer 064005 | 3.8 | 9.2 |

TABLE 26

Panel 3D

| Tissue Name | Rel. Exp. (%) Ag2581, Run 164827572 | Tissue Name | Rel. Exp. (%) Ag2581, Run 164827572 |
|---|---|---|---|
| Daoy-Medulloblastoma | 2.3 | Ca Ski- Cervical epidermoid carcinoma (metastasis) | 0.5 |
| TE671- Medulloblastoma | 0.9 | ES-2- Ovarian clear cell carcinoma | 1.2 |
| D283 Med- Medulloblastoma | 0.4 | Ramos- Stimulated with PMA/ionomycin 6h | 0.0 |
| PFSK-1- Primitive Neuroectodermal | 11.3 | Ramos- Stimulated with PMA/ionomycin 14h | 0.0 |
| XF-498- CNS | 0.7 | MEG-01- Chronic myelogenous leukemia (megokaryoblast) | 0.0 |
| SNB-78- Glioma | 0.0 | Raji- Burkitt's lymphoma | 0.3 |
| SF-268- Glioblastoma | 5.1 | Daudi- Burkitt's lymphoma | 0.1 |
| T98G- Glioblastoma | 0.4 | U266- B-cell plasmacytoma | 0.1 |
| SK-N-SH- Neuroblastoma (metastasis) | 20.9 | CA46- Burkitt's lymphoma | 0.0 |
| SF-295- Glioblastoma | 0.0 | RL- non-Hodgkin's B-cell lymphoma | 0.7 |
| Cerebellum | 2.3 | JM1- pre-B-cell lymphoma | 0.0 |
| Cerebellum | 2.2 | Jurkat- T cell leukemia | 0.4 |
| NCI-H292- Mucoepidermoid lung carcinoma | 1.3 | TF-1- Erythroleukemia | 0.4 |
| DMS-114- Small cell lung cancer | 0.0 | HUT 78- T-cell lymphoma | 0.3 |
| DMS-79- Small cell lung cancer | 4.3 | U937- Histiocytic lymphoma | 0.3 |
| NCI-H146- Small cell lung cancer | 6.6 | KU-812- Myelogenous leukemia | 0.0 |
| NCI-H526- Small cell lung cancer | 100.0 | 769-P- Clear cell renal carcinoma | 1.0 |
| NCI-N417- Small cell lung cancer | 1.8 | Caki-2- Clear cell renal carcinoma | 0.5 |
| NCI-H82- Small cell lung cancer | 0.3 | SW 839- Clear cell renal carcinoma | 3.5 |
| NCI-H157- Squamous cell lung cancer (metastasis) | 0.3 | G401- Wilms' tumor | 7.3 |
| NCI-H1155- Large cell lung cancer | 1.1 | Hs766T- Pancreatic carcinoma (LN metastasis) | 4.3 |
| NCI-H1299- Large cell lung cancer | 0.6 | CAPAN-1- Pancreatic adenocarcinoma (liver metastasis) | 0.0 |
| NCI-H727- Lung carcinoid | 6.2 | SU86.86- Pancreatic carcinoma (liver metastasis) | 0.8 |
| NCI-UMC-11- Lung carcinoid | 0.0 | BxPC-3- Pancreatic adenocarcinoma | 2.8 |
| LX-1- Small cell lung cancer | 0.0 | HPAC- Pancreatic adenocarcinoma | 0.0 |
| Colo-205- Colon cancer | 0.0 | MIA PaCa-2- Pancreatic carcinoma | 0.0 |
| KM12- Colon cancer | 0.0 | CFPAC-1- Pancreatic ductal adenocarcinoma | 0.0 |
| KM20L2- Colon cancer | 0.0 | PANC-1- Pancreatic epithelioid ductal carcinoma | 0.0 |
| NCI-H716- Colon cancer | 0.9 | T24- Bladder carcinma (transitional cell) | 3.1 |
| SW-48- Colon adenocarcinoma | 0.0 | 5637- Bladder carcinoma | 1.0 |
| SW1116- Colon adenocarcinoma | 0.0 | HT-1197- Bladder carcinoma | 1.3 |

TABLE 26-continued

Panel 3D

| Tissue Name | Rel. Exp. (%) Ag2581, Run 164827572 | Tissue Name | Rel. Exp. (%) Ag2581, Run 164827572 |
|---|---|---|---|
| LS 174T- Colon adenocarcinoma | 0.0 | UM-UC-3- Bladder carcinma (transitional cell) | 1.3 |
| SW-948- Colon adenocarcinoma | 0.0 | A204- Rhabdomyosarcoma | 0.3 |
| SW-480- Colon adenocarcinoma | 0.1 | HT-1080- Fibrosarcoma | 12.4 |
| NCI-SNU-5- Gastric carcinoma | 0.0 | MG-63- Osteosarcoma | 0.2 |
| KATO III- Gastric carcinoma | 0.0 | SK-LMS-1- Leiomyosarcoma (vulva) | 9.5 |
| NCI-SNU-16- Gastric carcinoma | 0.2 | SJRH30- Rhabdomyosarcoma (met to bone marrow) | 0.8 |
| NCI-SNU-1- Gastric carcinoma | 0.0 | A431-Epidermoid carcinoma | 0.4 |
| RF-1- Gastric adenocarcinoma | 0.0 | WM266-4- Melanoma | 1.8 |
| RF-48- Gastric adenocarcinoma | 0.0 | DU 145- Prostate carcinoma (brain metastasis) | 0.0 |
| MKN-45- Gastric carcinoma | 0.5 | MDA-MB-468- Breast adenocarcinoma | 0.0 |
| NCI-N87- Gastric carcinoma | 0.6 | SCC-4- Squamous cell carcinoma of tongue | 0.0 |
| OVCAR-5- Ovarian carcinoma | 0.2 | SCC-9- Squamous cell carcinoma of tongue | 0.0 |
| RL95-2- Uterine carcinoma | 0.6 | SCC-15- Squamous cell carcinoma of tongue | 0.5 |
| HelaS3- Cervical adenocarcinoma | 0.2 | CAL 27- Squamous cell carcinoma of tongue | 0.0 |

TABLE 27

Panel 4D

| Tissue Name | Rel. Exp. (%) Ag1479, Run 162599612 | Rel. Exp. (%) Ag2581, Run 164036199 | Rel. Exp. (%) Ag2910, Run 159079044 | Tissue Name | Rel. Exp. (%) Ag1479, Run 162599612 | Rel. Exp. (%) Ag2581, Run 164036199 | Rel. Exp. (%) Ag2910, Run 159079044 |
|---|---|---|---|---|---|---|---|
| Secondary Th1 act | 0.3 | 0.0 | 0.2 | HUVEC IL-1 beta | 8.1 | 0.0 | 0.0 |
| Secondary Th2 act | 0.0 | 0.0 | 0.0 | HUVEC IFN gamma | 14.8 | 0.0 | 0.0 |
| Secondary Tr1 act | 0.0 | 0.0 | 0.6 | HUVEC TNF alpha + IFN gamma | 8.1 | 0.0 | 0.0 |
| Secondary Th1 rest | 0.0 | 0.0 | 0.0 | HUVEC TNF alpha + IL4 | 12.0 | 0.0 | 0.0 |
| Secondary Th2 rest | 0.0 | 0.0 | 0.0 | HUVEC IL-11 | 8.5 | 0.0 | 0.0 |
| Secondary Tr1 rest | 0.0 | 0.0 | 0.0 | Lung Microvascular EC none | 11.1 | 0.0 | 0.0 |
| Primary Th1 act | 0.0 | 0.0 | 0.0 | Lung Microvascular EC TNF alpha + IL-1 beta | 9.3 | 0.0 | 0.0 |
| Primary Th2 act | 0.0 | 0.0 | 0.0 | Microvascular Dermal EC none | 100.0 | 0.0 | 0.5 |
| Primary Tr1 act | 0.0 | 0.0 | 0.0 | Microsvasular Dermal EC TNF alpha + IL-1 beta | 29.7 | 0.0 | 0.6 |
| Primary Th1 rest | 0.0 | 0.0 | 0.0 | Bronchial epithelium TNF alpha + IL1 beta | 0.2 | 0.2 | 21.8 |
| Primary Th2 rest | 0.0 | 0.0 | 0.0 | Small airway epithelium none | 2.2 | 0.6 | 4.4 |

TABLE 27-continued

Panel 4D

| Tissue Name | Rel. Exp. (%) Ag1479, Run 162599612 | Rel. Exp. (%) Ag2581, Run 164036199 | Rel. Exp. (%) Ag2910, Run 159079044 | Tissue Name | Rel. Exp. (%) Ag1479, Run 162599612 | Rel. Exp. (%) Ag2581, Run 164036199 | Rel. Exp. (%) Ag2910, Run 159079044 |
|---|---|---|---|---|---|---|---|
| Primary Tr1 rest | 0.0 | 0.0 | 0.0 | Small airway epithelium TNF alpha + IL-1 beta | 0.3 | 0.5 | 4.7 |
| CD45RA CD4 lymphocyte act | 1.8 | 0.1 | 0.2 | Coronery artery SMC rest | 8.3 | 0.0 | 2.4 |
| CD45RO CD4 lymphocyte act | 0.0 | 0.0 | 0.3 | Coronery artery SMC TNF alpha + IL-1 beta | 4.6 | 0.0 | 0.3 |
| CD8 lymphocyte act | 0.0 | 0.0 | 0.0 | Astrocytes rest | 85.9 | 2.9 | 19.3 |
| Secondary CD8 lymphocyte rest | 0.0 | 0.0 | 0.0 | Astrocytes TNF alpha + IL-1 beta | 59.0 | 1.9 | 17.0 |
| Secondary CD8 lymphocyte act | 0.0 | 0.0 | 0.0 | KU-812 (Basophil) rest | 0.0 | 0.0 | 0.3 |
| CD4 lymphocyte none | 0.0 | 0.0 | 0.0 | KU-812 (Basophil) PMA/ionomycin | 0.0 | 0.0 | 0.0 |
| 2ry Th1/Th2/Tr1_anti-CD95 CH11 | 0.0 | 0.0 | 0.0 | CCD1106 (Keratinocytes) none | 19.8 | 0.7 | 4.8 |
| LAK cells rest | 0.0 | 0.0 | 0.6 | CCD1106 (Keratinocytes) TNF alpha + IL-1 beta | 1.7 | 0.0 | 1.7 |
| LAK cells IL-2 | 0.0 | 0.0 | 0.0 | Liver cirrhosis | 0.0 | 0.1 | 1.7 |
| LAK cells IL-2 + IL-12 | 0.0 | 0.0 | 0.0 | Lupus kidney | 1.8 | 0.1 | 0.7 |
| LAK cells IL-2 + IFN gamma | 0.0 | 100.0 | 0.0 | NCI-H292 none | 0.0 | 0.1 | 0.5 |
| LAK cells IL-2 + IL-18 | 0.0 | 0.0 | 0.2 | NCI-H292 IL-4 | 0.0 | 0.0 | 0.6 |
| LAK cells PMA/ionomycin | 0.0 | 0.0 | 0.0 | NCI-H292 IL-9 | 0.0 | 0.1 | 3.5 |
| NK Cells IL-2 rest | 0.0 | 0.0 | 0.0 | NCI-H292 IL-13 | 0.0 | 0.1 | 0.1 |
| Two Way MLR 3 day | 0.0 | 0.0 | 0.0 | NCI-H292 IFN gamma | 0.0 | 0.2 | 0.0 |
| Two Way MLR 5 day | 0.0 | 0.0 | 0.0 | HPAEC none | 15.1 | 0.0 | 0.0 |
| Two Way MLR 7 day | 0.0 | 0.0 | 0.3 | HPAEC TNF alpha + IL-1 beta | 6.2 | 0.0 | 0.0 |
| PBMC rest | 0.0 | 0.0 | 0.0 | Lung fibroblast none | 0.9 | 5.8 | 51.1 |
| PBMC PWM | 0.0 | 0.0 | 0.6 | Lung fibroblast TNF alpha + IL-1 beta | 0.6 | 1.2 | 13.0 |
| PBMC PHA-L | 0.0 | 0.0 | 0.0 | Lung fibroblast IL-4 | 2.1 | 8.3 | 82.9 |
| Ramos (B cell) none | 0.0 | 0.0 | 0.0 | Lung fibroblast IL-9 | 1.2 | 6.7 | 50.7 |
| Ramos (B cell) ionomycin | 0.0 | 0.0 | 0.0 | Lung fibroblast IL-13 | 1.2 | 6.3 | 67.4 |
| B lymphocytes PWM | 0.0 | 0.0 | 0.0 | Lung fibroblast IFN gamma | 2.1 | 8.4 | 100.0 |
| B lymphocytes CD40L and IL-4 | 0.2 | 0.1 | 0.0 | Dermal fibroblast CCD1070 rest | 10.5 | 0.5 | 8.4 |
| EOL-1 dbcAMP | 0.2 | 0.0 | 0.0 | Dermal fibroblast CCD1070 TNF alpha | 11.6 | 0.3 | 7.3 |
| EOL-1 dbcAMP PMA/ionomycin | 0.1 | 0.0 | 0.0 | Dermal fibroblast CCD1070 IL-1 beta | 4.9 | 0.3 | 2.0 |
| Dendritic cells none | 0.0 | 0.0 | 0.6 | Dermal fibroblast IFN gamma | 1.2 | 0.1 | 1.1 |
| Dendritic cells LPS | 0.0 | 0.0 | 0.0 | Dermal fibroblast IL-4 | 28.3 | 0.3 | 11.7 |

TABLE 27-continued

| Panel 4D | | | | | | | |
|---|---|---|---|---|---|---|---|
| Tissue Name | Rel. Exp. (%) Ag1479, Run 162599612 | Rel. Exp. (%) Ag2581, Run 164036199 | Rel. Exp. (%) Ag2910, Run 159079044 | Tissue Name | Rel. Exp. (%) Ag1479, Run 162599612 | Rel. Exp. (%) Ag2581, Run 164036199 | Rel. Exp. (%) Ag2910, Run 159079044 |
| Dendritic cells anti-CD40 | 0.0 | 0.0 | 0.0 | IBD Colitis 2 | 0.7 | 0.2 | 0.6 |
| Monocytes rest | 0.0 | 0.1 | 2.7 | IBD Crohn's | 1.6 | 0.0 | 0.2 |
| Monocytes LPS | 0.0 | 0.0 | 0.2 | Colon | 8.6 | 0.1 | 3.1 |
| Macrophages rest | 0.0 | 0.0 | 0.0 | Lung | 2.0 | 8.0 | 12.3 |
| Macrophages LPS | 0.0 | 0.0 | 0.0 | Thymus | 7.0 | 1.7 | 20.4 |
| HUVEC none | 23.0 | 0.0 | 0.0 | Kidney | 17.0 | 1.2 | 16.7 |
| HUVEC starved | 25.0 | 0.0 | 0.0 | | | | |

CNS_neurodegeneration_v1.0 Summary: Ag2910/Ag2581 Results from two experiments using identical probe/primer sets are in excellent agreement. No difference is detected in the expression of the CG56091-01 gene in the postmortem brains of Alzheimer's patients when compared to normal controls. However, this panel does demonstrate the expression of this gene in the CNS of an independent group of patients. Please see panel 1.3D for a discussion of the potential utility of this gene in function of the central nervous system.

Panel 1.3D Summary: Ag1479/2674/Ag2820 The CG56091-01 gene encodes a protein that is homologous to TEN-M4 and may be involved in brain compartmentalization. In multiple experiments with different probe/primer sets, highest expression of this gene is seen in the brain and in brain cancer cell lines. Thus, inhibitors of this gene product could have utility in the treatment of diseases involving neurite outgrowth or organization, such as neurodegenerative diseases.

In addition to expression in brain cancer cell lines, there is substantial expression in other samples derived from cancer cell lines, such as breast cancer, lung cancer ovarian cancer. Thus, the expression of this gene could be used to distinguish these samples from other samples in the panel. Moreover, therapeutic modulation of this gene or its protein product, through the use of small molecule drugs, antibodies or protein therapeutics, might be of use in the treatment of brain cancer, lung cancer, breast cancer or ovarian cancer.

This gene is also moderately expressed metabolic and endocrine tissues, including adrenal, thyroid, pituitary, fetal heart, adult and fetal skeletal muscle, and adipose. Thus, this gene product may be an antibody target for the treatment of any or all diseases in these tissues, including obesity and diabetes (Mieda M, Kikuchi Y, Hirate Y, Aoki M, Okamoto H. Compartmentalized expression of zebrafish ten-m3 and ten-m4, homologues of the *Drosophila* ten(m)/odd Oz gene, in the central nervous system. Mech Dev 1999 Sep; 87(1–2):223–7).

Panel 2D Summary: Ag2581/Ag2910 Results from two experiments using an identical probe/primer set show reasonable concordance, with both runs showing highest expression of the CG56091-01 gene in ovarian cancer (CT=28–29). In addition, the level of expression of this gene appears to be increased in some lung and gastric cancer tissue samples when compared to the matched normal tissue. The reverse appears to be true for kidney, where expression is slightly higher in 6 of 9 normal tissues than in the matched cancer tissues. Thus, based upon its profile, the expression of this gene could be of use as a marker for distinguishing these cancers from the normal adjacent tissue or as a marker for different grades/types of cancer. Furthermore, therapeutic inhibition of the activity of the product of this gene, through the use of antibodies, peptides or polypeptides, may be useful in the treatment of gastric and lung cancer.

Panel 3D Summary: Ag2581 The CG56091-01 gene is expressed at a low level by select cell lines used in this panel. The highest level of expression is seen in NCI-H526, a lung cancer cell line (CT=27.3). Other cell lines that express this gene include neuroblastoma, bladder carcinoma and renal cell cancer cell lines. Therefore, therapeutic inhibition of the activity of the product of this gene, through the use of antibodies, peptides or polypeptides may be useful in the therapy of cancers used in the derivation of these cell lines.

Panel 4D Summary: Ag1479/Ag2674/Ag2820 The expression of the CG56091-01 gene is highest in astrocytes and microvascular dermal endothelial cells (CTs=29–30), with low but significant expression in keratinocytes, and dermal fibroblasts. Expression is not modulated by any treatment, suggesting that this protein may be important in normal homeostasis. Thus, this transcript or the protein it encodes could be used to identify the tissues and cells in which it is expressed.

B. NOV2: Semphorin-like

Expression of the NOV2 gene (20422974_0_132da1) was assessed using the primer-probe set Ag37, described in Table 28. Results of the RTQ-PCR runs are shown in Table 29.

TABLE 28

| Probe Name Ag37 | | | | |
|---|---|---|---|---|
| Primers | Sequences | | Length | Start Position |
| Forward | 5'-ggcttcctcatggtactcctta-3' | (SEQ ID NO:199) | 22 | 983 |
| Probe | TET-5'-ccgctggatctcttccaactggtact-3'-TAMRA | (SEQ ID NO:200) | 26 | 940 |
| Reverse | 5'-acagtggggtgacatgtacct-3' | (SEQ ID NO:201) | 21 | 905 |

TABLE 29

Panel 1

| Tissue Name | Rel. Exp. (%) Ag37, Run 87355114 | Tissue Name | Rel. Exp. (%) Ag37, Run 87355114 |
|---|---|---|---|
| Endothelial cells | 1.1 | Renal ca. 786-0 | 4.6 |
| Endothelial cells (treated) | 2.2 | Renal ca. A498 | 2.7 |
| Pancreas | 4.9 | Renal ca. RXF 393 | 3.2 |
| Pancreatic ca. CAPAN 2 | 2.0 | Renal ca. ACHN | 2.4 |
| Adrenal gland | 9.2 | Renal ca. UO-31 | 1.7 |
| Thyroid | 6.3 | Renal ca. TK-10 | 4.3 |
| Salivary gland | 4.6 | Liver | 8.5 |
| Pituitary gland | 9.1 | Liver (fetal) | 4.5 |
| Brain (fetal) | 12.1 | Liver ca. (hepatoblast) HepG2 | 7.1 |
| Brain (whole) | 24.0 | Lung | 4.5 |
| Brain (amygdala) | 6.4 | Lung (fetal) | 15.1 |
| Brain (cerebellum) | 37.9 | Lung ca. (small cell) LX-1 | 3.7 |
| Brain (hippocampus) | 28.7 | Lung ca. (small cell) NCI-H69 | 2.1 |
| Brain (substantia nigra) | 15.1 | Lung ca. (s.cell var.) SHP-77 | 0.0 |
| Brain (thalamus) | 14.5 | Lung ca. (large cell) NCI-H460 | 0.0 |
| Brain (hypothalamus) | 4.0 | Lung ca. (non-sm. cell) A549 | 3.0 |
| Spinal cord | 32.3 | Lung ca. (non-s. cell) NCI-H23 | 12.1 |
| glio/astro U87-MG | 1.9 | Lung ca. (non-s. cell) HOP-62 | 4.7 |
| glio/astro U-118-MG | 2.4 | Lung ca. (non-s. cl) NCI-H522 | 14.1 |
| astrocytoma SW1783 | 0.7 | Lung ca. (squam.) SW 900 | 13.9 |
| neuro*; met SK-N-AS | 11.0 | Lung ca. (squam.) NCI-H596 | 2.0 |
| astrocytoma SF-539 | 9.3 | Mammary gland | 16.4 |
| astrocytoma SNB-75 | 10.5 | Breast ca.* (pl. ef) MCF-7 | 100.0 |
| glioma SNB-19 | 5.3 | Breast ca.* (pl. ef) MDA-MB-231 | 1.4 |
| glioma U251 | 1.6 | Breast ca.* (pl. ef) T47D | 2.6 |
| glioma SF-295 | 3.7 | Breast ca. BT-549 | 0.0 |
| Heart | 8.3 | Breast ca. MDA-N | 7.3 |
| Skeletal muscle | 2.9 | Ovary | 18.8 |
| Bone marrow | 1.9 | Ovarian ca. OVCAR-3 | 6.1 |
| Thymus | 5.8 | Ovarian ca. OVCAR-4 | 1.5 |
| Spleen | 18.8 | Ovarian ca. OVCAR-5 | 5.5 |
| Lymph node | 13.0 | Ovarian ca. OVCAR-8 | 6.9 |
| Colon (ascending) | 2.0 | Ovarian ca. IGROV-1 | 2.6 |
| Stomach | 7.2 | Ovarian ca. (ascites) SK-OV-3 | 2.5 |
| Small intestine | 6.5 | Uterus | 6.2 |
| Colon ca. SW480 | 1.3 | Placenta | 45.4 |
| Colon ca.* SW620 (SW480 met) | 2.9 | Prostate | 12.3 |
| Colon ca. HT29 | 0.9 | Prostate ca.* (bone met) PC-3 | 0.0 |
| Colon ca. HCT-116 | 0.0 | Testis | 8.9 |
| Colon ca. CaCo-2 | 5.9 | Melanoma Hs688(A).T | 1.0 |
| Colon ca. HCT-15 | 4.9 | Melanoma* (met) Hs688(B).T | 1.2 |
| Colon ca. HCC-2998 | 1.5 | Melanoma UACC-62 | 1.6 |
| Gastric ca.* (liver met) NCI-N87 | 6.3 | Melanoma M14 | 9.7 |
| Bladder | 5.4 | Melanoma LOX IMVI | 9.8 |
| Trachea | 8.5 | Melanoma* (met) SK-MEL-5 | 5.8 |
| Kidney | 4.5 | Melanoma SK-MEL-28 | 9.2 |
| Kidney (fetal) | 11.8 | | |

CNS_neurodegeneration_v1.0 Summary: Ag37 Expression of this gene is low/undetectable (CTs>35) across all of the samples on this panel (data not shown).

General_screening_panel_v1.4 Summary: Ag37 Results from one experiment with the 20422974_0_132_da1 gene are not included. The amp plot indicates that there were experimental difficulties with this run.

Panel 1 Summary: Ag37 The 20422974_0_132da1 gene is expressed at high to moderate levels in the majority of the samples on this panel. Expression of this gene is highest in a breast cancer cell line (CT=22). In addition, there is substantial expression in placental tissue and in a number of brain regions. Thus, the expression of this gene could be used to distinguish the sample derived from MCF-7 cells from other samples in the panel. Moreover, therapeutic modulation of this gene or its protein product, through the use of small molecule drugs, antibodies or protein therapeutics, might be of benefit in the treatment of breast cancer. In general, however, expression appears to be higher in normal cells than in the cancer cell lines.

Among tissues with endocrine or metabolic activity, this gene is expressed at high levels in pancreas, adrenal gland, thyroid, pituitary gland, hypothalamus, heart, skeletal muscle, and liver. This observation indicates an importance for this gene in endocrine and metaboic physiology. Therefore, therapeutic modulation of this gene and/or gene product may prove useful in the treatment of diseases associated with these physiological systems, including diabetes and obesity.

Expression of the gene is very high throughout the central nervous system including in the spinal cord, amygdala, cerebellum, hippocampus, thalamus, and substantia nigra. This gene encodes a protein with homology to sempaphorins. Semaphorins can act as axon guidance proteins, specifically as chemorepellents that inhibit CNS regenerative capacity. Therefore, therapeutic modulation of the activity and/or amount of this protein may be of use in inducing a compensatory synaptogenic response to neuronal death in Alzheimer's disease, Parkinson's disease, Huntington's disease, spinocerebellar ataxia, progressive supranuclear palsy, multiple sclerosis, ALS, head trauma, stroke, or any other disease/condition associated with neuronal loss.

Panel 4.1D Summary: Ag37 Expression of this gene is low/undetectable (CTs>35) across all of the samples on this panel (data not shown).

C. NOV3: Erythroid Membrane-associated Protein

Expression of the NOV3 gene (CG50351-01) was assessed using the primer-probe set Ag2623, described in Table 30. Results of the RTQ-PCR runs are shown in Tables 31–34.

TABLE 30

Probe Name Ag2623

| Primers | Sequences | | Length | Start Position |
|---|---|---|---|---|
| Forward | 5'-tggactatgaagcaggagtcat-3' | (SEQ ID NO:202) | 22 | 1397 |
| Probe | TET-5'-caatgtgaccaacaagtcccacatct-3'-TAMRA | (SEQ ID NO:203) | 26 | 1428 |
| Reverse | 5'-cagagaaattgtgggtgaaagt-3' | (SEQ ID NO:204) | 22 | 1456 |

TABLE 31

CNS_neurodegeneration_v1.0

| Tissue Name | Rel. Exp. (%) Ag2623, Run 208393898 | Tissue Name | Rel. Exp. (%) Ag2623, Run 208393898 |
|---|---|---|---|
| AD 1 Hippo | 32.5 | Control (Path) 3 Temporal Ctx | 13.0 |
| AD 2 Hippo | 48.6 | Control (Path) 4 Temporal Ctx | 40.3 |
| AD 3 Hippo | 12.2 | AD 1 Occipital Ctx | 22.8 |
| AD 4 Hippo | 14.3 | AD 2 Occipital Ctx (Missing) | 0.0 |
| AD 5 Hippo | 87.1 | AD 3 Occipital Ctx | 6.9 |
| AD 6 Hippo | 65.1 | AD 4 Occipital Ctx | 25.3 |
| Control 2 Hippo | 40.6 | AD 5 Occipital Ctx | 33.9 |
| Control 4 Hippo | 43.2 | AD 6 Occipital Ctx | 12.5 |
| Control (Path) 3 Hippo | 15.8 | Control 1 Occipital Ctx | 5.1 |
| AD 1 Temporal Ctx | 33.4 | Control 2 Occipital Ctx | 46.7 |
| AD 2 Temporal Ctx | 47.6 | Control 3 Occipital Ctx | 19.9 |
| AD 3 Temporal Ctx | 9.0 | Control 4 Occipital Ctx | 14.5 |
| AD 4 Temporal Ctx | 35.4 | Control (Path) 1 Occipital Ctx | 72.2 |
| AD 5 Inf Temporal Ctx | 97.9 | Control (Path) 2 Occipital Ctx | 10.8 |
| AD 5 Sup Temporal Ctx | 85.3 | Control (Path) 3 Occipital Ctx | 8.1 |
| AD 6 Inf Temporal Ctx | 38.7 | Control (Path) 4 Occipital Ctx | 20.0 |
| AD 6 Sup Temporal Ctx | 50.0 | Control 1 Parietal Ctx | 11.9 |
| Control 1 Temporal Ctx | 11.4 | Control 2 Parietal Ctx | 100.0 |
| Control 2 Temporal Ctx | 38.2 | Control 3 Parietal Ctx | 22.2 |
| Control 3 Temporal Ctx | 18.3 | Control (Path) 1 Parietal Ctx | 45.4 |
| Control 3 Temporal Ctx | 24.7 | Control (Path) 2 Parietal Ctx | 27.4 |
| Control (Path) 1 Temporal Ctx | 58.2 | Control(Path) 3 Parietal Ctx | 6.3 |
| Control (Path) 2 Temporal Ctx | 42.0 | Control (Path) 4 Parietal Ctx | 25.2 |

TABLE 32

Panel 1.3D

| Tissue Name | Rel. Exp. (%) Ag2623, Run 167644904 | Tissue Name | Rel. Exp. (%) Ag2623, Run 167644904 |
|---|---|---|---|
| Liver adenocarcinoma | 12.9 | Kidney (fetal) | 51.1 |
| Pancreas | 3.9 | Renal ca. 786-0 | 11.0 |
| Pancreatic ca. CAPAN 2 | 4.9 | Renal ca. A498 | 4.1 |
| Adrenal gland | 3.1 | Renal ca. RXF 393 | 7.9 |
| Thyroid | 6.3 | Renal ca. ACHN | 4.4 |
| Salivary gland | 4.3 | Renal ca. UO-31 | 3.9 |
| Pituitary gland | 9.9 | Renal ca. TK-10 | 7.8 |
| Brain (fetal) | 3.8 | Liver | 8.2 |
| Brain (whole) | 7.5 | Liver (fetal) | 100.0 |
| Brain (amygdala) | 5.3 | Liver ca. (hepatoblast) HepG2 | 3.6 |
| Brain (cerebellum) | 3.6 | Lung | 4.1 |
| Brain (hippocampus) | 3.9 | Lung (fetal) | 8.4 |
| Brain (substantia nigra) | 7.3 | Lung ca. (small cell) LX-1 | 4.1 |
| Brain (thalamus) | 4.8 | Lung ca. (small cell) NCI-H69 | 0.4 |
| Cerebral Cortex | 7.4 | Lung ca. (s. cell var.) SHP-77 | 3.4 |
| Spinal cord | 9.4 | Lung ca. (large cell)NCI-H460 | 2.2 |
| glio/astro U87-MG | 9.6 | Lung ca. (non-sm. cell) A549 | 7.4 |
| glio/astro U-118-MG | 6.9 | Lung ca. (non-s. cell) NCI-H23 | 3.5 |
| astrocytoma SW1783 | 6.7 | Lung ca. (non-s. cell) HOP-62 | 8.7 |
| neuro*; met SK-N-AS | 1.6 | Lung ca. (non-s. cl) NCI-H522 | 3.3 |
| astrocytoma SF-539 | 5.7 | Lung ca. (squam.) SW 900 | 3.9 |
| astrocytoma SNB-75 | 12.6 | Lung ca. (squam.) NCI-H596 | 1.7 |
| glioma SNB-19 | 5.5 | Mammary gland | 12.8 |
| glioma U251 | 12.7 | Breast ca.* (pl. ef) MCF-7 | 7.5 |
| glioma SF-295 | 7.3 | Breast ca.* (pl. ef) MDA-MB-231 | 2.9 |
| Heart (fetal) | 5.1 | Breast ca.* (pl. ef) T47D | 15.4 |
| Heart | 2.5 | Breast ca. BT-549 | 4.5 |
| Skeletal muscle (fetal) | 3.5 | Breast ca. MDA-N | 1.6 |
| Skeletal muscle | 2.6 | Ovary | 4.9 |
| Bone marrow | 31.9 | Ovarian ca. OVCAR-3 | 6.6 |
| Thymus | 5.7 | Ovarian ca. OVCAR-4 | 4.2 |
| Spleen | 3.0 | Ovarian ca. OVCAR-5 | 18.4 |
| Lymph node | 2.7 | Ovarian ca. OVCAR-8 | 2.0 |
| Colorectal | 8.9 | Ovarlan ca. IGROV-1 | 1.9 |
| Stomach | 3.8 | Ovarian ca.* (ascites) SK-OV-3 | 28.9 |
| Small intestine | 1.6 | Uterus | 5.1 |
| Colon ca. SW480 | 5.5 | Placenta | 0.9 |
| Colon ca.* SW620 (SW480 met) | 17.3 | Prostate | 2.9 |
| Colon ca. HT29 | 3.8 | Prostate ca.* (bone met) PC-3 | 3.7 |
| Colon ca. HCT-116 | 1.5 | Testis | 1.0 |
| Colon ca. CaCo-2 | 4.4 | Melanoma Hs688(A).T | 4.8 |
| Colon ca. tissue (ODO3866) | 3.4 | Melanoma* (met) Hs688(B).T | 3.0 |
| Colon ca. HCC-2998 | 6.3 | Melanoma UACC-62 | 3.8 |
| Gastric ca.* (liver met) NCI-N87 | 8.2 | Melanoma M14 | 1.3 |
| Bladder | 6.7 | Melanoma LOX IMVI | 0.8 |
| Trachea | 4.3 | Melanoma* (met) SK-MEL-5 | 0.3 |
| Kidney | 7.7 | Adipose | 7.7 |

TABLE 33

Panel 2.2

| Tissue Name | Rel. Exp. (%) Ag2623, Run 175063692 | Tissue Name | Rel. Exp. (%) Ag2623, Run 175063692 |
|---|---|---|---|
| Normal Colon | 33.7 | Kidney Margin (OD04348) | 70.2 |
| Colon cancer (OD06064) | 48.3 | Kidney malignant cancer (OD06204B) | 18.3 |
| Colon Margin (OD06064) | 57.0 | Kidney normal adjacent tissue (OD06204E) | 27.2 |

TABLE 33-continued

Panel 2.2

| Tissue Name | Rel. Exp. (%) Ag2623, Run 175063692 | Tissue Name | Rel. Exp. (%) Ag2623, Run 175063692 |
|---|---|---|---|
| Colon cancer (OD06159) | 4.6 | Kidney Cancer (OD04450-01) | 46.3 |
| Colon Margin (OD06159) | 19.3 | Kidney Margin (OD04450-03) | 18.7 |
| Colon cancer (OD06297-04) | 2.1 | Kidney Cancer 8120613 | 2.9 |
| Colon Margin (OD06297-015) | 30.8 | Kidney Margin 8120614 | 17.9 |
| CC Gr.2 ascend colon (ODO3921) | 2.9 | Kidney Cancer 9010320 | 7.1 |
| CC Margin (ODO3921) | 2.8 | Kidney Margin 9010321 | 5.3 |
| Colon cancer metastasis (OD06104) | 8.0 | Kidney Cancer 8120607 | 14.0 |
| Lung Margin (OD06104) | 16.4 | Kidney Margin 8120608 | 3.8 |
| Colon mets to lung (OD04451-01) | 7.5 | Normal Uterus | 68.3 |
| Lung Margin (OD04451-02) | 25.7 | Uterine Cancer 064011 | 15.8 |
| Normal Prostate | 16.0 | Normal Thyroid | 17.8 |
| Prostate Cancer (OD04410) | 9.7 | Thyroid Cancer 064010 | 29.1 |
| Prostate Margin (OD04410) | 9.3 | Thyroid Cancer A302152 | 34.6 |
| Normal Ovary | 11.2 | Thyroid Margin A302153 | 6.2 |
| Ovarian cancer (OD06283-03) | 18.6 | Normal Breast | 49.0 |
| Ovarian Margin (OD06283-07) | 8.6 | Breast Cancer (OD04566) | 7.5 |
| Ovarian Cancer 064008 | 10.7 | Breast Cancer 1024 | 36.6 |
| Ovarian cancer (OD06145) | 4.8 | Breast Cancer (OD04590-01) | 20.4 |
| Ovarian Margin (OD06145) | 18.2 | Breast Cancer Mets (OD04590-03) | 34.6 |
| Ovarian cancer (OD06455-03) | 14.3 | Breast Cancer Metastasis (OD04655-05) | 40.9 |
| Ovarian Margin (OD06455-07) | 18.7 | Breast Cancer 064006 | 19.1 |
| Normal Lung | 5.8 | Breast Cancer 9100266 | 17.7 |
| Invasive poor diff. lung adeno (ODO4945-01 | 10.7 | Breast Margin 9100265 | 33.9 |
| Lung Margin (ODO4945-03) | 16.7 | Breast Cancer A209073 | 5.4 |
| Lung Malignant Cancer (OD03126) | 5.3 | Breast Margin A2090734 | 21.0 |
| Lung Margin (OD03126) | 4.7 | Breast cancer (OD06083) | 62.4 |
| Lung Cancer (OD05014A) | 7.7 | Breast cancer node metastasis (OD06083) | 34.2 |
| Lung Margin (OD05014B) | 49.0 | Normal Liver | 32.1 |
| Lung cancer (OD06081) | 34.2 | Liver Cancer 1026 | 6.0 |
| Lung Margin (OD06081) | 17.7 | Liver Cancer 1025 | 39.0 |
| Lung Cancer (OD04237-01) | 6.4 | Liver Cancer 6004-T | 16.4 |
| Lung Margin (OD04237-02) | 13.9 | Liver Tissue 6004-N | 6.4 |
| Ocular Melanoma Metastasis | 5.7 | Liver Cancer 6005-T | 27.4 |
| Ocular Melanoma Margin (Liver) | 24.7 | Liver Tissue 6005-N | 45.1 |
| Melanoma Metastasis | 4.8 | Liver Cancer 064003 | 10.3 |
| Melanoma Margin (Lung) | 20.9 | Normal Bladder | 18.2 |
| Normal Kidney | 11.7 | Bladder Cancer 1023 | 7.3 |
| Kidney Ca, Nuclear grade 2 (OD04338) | 48.0 | Bladder Cancer A302173 | 8.1 |
| Kidney Margin (OD04338) | 25.9 | Normal Stomach | 31.6 |
| Kidney Ca Nuclear grade 1/2 (OD04339) | 100.0 | Gastric Cancer 9060397 | 2.3 |
| Kidney Margin (OD04339) | 20.3 | Stomach Margin 9060396 | 10.3 |
| Kidney Ca, Clear cell type (OD04340) | 8.8 | Gastric Cancer 9060395 | 13.4 |
| Kidney Margin (OD04340) | 16.6 | Stomach Margin 9060394 | 27.5 |
| Kidney Ca, Nuclear grade 3 (OD04348) | 8.2 | Gastric Cancer 064005 | 6.9 |

TABLE 34

Panel 4D

| Tissue Name | Rel. Exp. (%) Ag2623, Run 164299479 | Tissue Name | Rel. Exp. (%) Ag2623, Run 164299479 |
|---|---|---|---|
| Secondary Th1 act | 2.5 | HUVEC IL-1 beta | 1.2 |
| Secondary Th2 act | 4.2 | HUVEC IFN gamma | 5.2 |
| Secondary Tr1 act | 4.1 | HUVEC TNF alpha + IFN gamma | 4.1 |
| Secondary Th1 rest | 2.4 | HUVEC TNF alpha + IL4 | 4.4 |
| Secondary Th2 rest | 2.4 | HUVEC IL-11 | 3.8 |

TABLE 34-continued

Panel 4D

| Tissue Name | Rel. Exp. (%) Ag2623, Run 164299479 | Tissue Name | Rel. Exp. (%) Ag2623, Run 164299479 |
|---|---|---|---|
| Secondary Tr1 rest | 3.8 | Lung Microvascular EC none | 11.7 |
| Primary Th1 act | 3.2 | Lung Microvascular EC TNF alpha + IL-1 beta | 8.7 |
| Primary Th2 act | 3.8 | Microvascular Dermal EC none | 14.3 |
| Primary Tr1 act | 3.3 | Microvascular Dermal EC TNF alpha + IL-1 beta | 7.0 |
| Primary Th1 rest | 11.3 | Bronchial epithelium TNF alpha + IL1 beta | 10.7 |
| Primary Th2 rest | 7.7 | Small airway epithelium none | 3.2 |
| Primary Tr1 rest | 6.2 | Small airway epithelium TNF alpha + IL-1 beta | 14.5 |
| CD45RA CD4 lymphocyte act | 4.5 | Coronery artery SMC rest | 6.0 |
| CD45RO CD4 lymphocyte act | 3.1 | Coronery artery SMC TNF alpha + IL-1 beta | 4.0 |
| CD8 lymphocyte act | 2.5 | Astrocytes rest | 8.2 |
| Secondary CD8 lymphocyte rest | 2.3 | Astrocytes TNF alpha + IL-1 beta | 7.6 |
| Secondary CD8 lymphocyte act | 2.5 | KU-812 (Basophil) rest | 77.9 |
| CD4 lymphocyte none | 1.9 | KU-812 (Basophil) PMA/ionomycin | 100.0 |
| 2ry Th1/Th2/Tr1_anti-CD95 CH11 | 4.7 | CCD1106 (Keratinocytes) none | 3.1 |
| LAK cells rest | 5.8 | CCD1106 (Keratinocytes) TNF alpha + IL-1 beta | 1.3 |
| LAK cells IL-2 | 5.8 | Liver cirrhosis | 4.0 |
| LAK cells IL-2 + IL-12 | 4.0 | Lupus kidney | 1.8 |
| LAK cells IL-2 + IFN gamma | 6.5 | NCI-H292 none | 23.3 |
| LAK cells IL-2 + IL-18 | 3.5 | NCI-H292 IL-4 | 23.3 |
| LAK cells PMA/ionomycin | 1.2 | NCI-H292 IL-9 | 24.3 |
| NK Cells IL-2 rest | 4.2 | NCI-H292 IL-13 | 13.2 |
| Two Way MLR 3 day | 9.0 | NCI-H292 IFN gamma | 15.3 |
| Two Way MLR 5 day | 3.0 | HPAEC none | 4.8 |
| Two Way MLR 7 day | 1.5 | HPAEC TNF alpha + IL-1 beta | 6.2 |
| PBMC rest | 3.6 | Lung fibroblast none | 12.3 |
| PBMC PWM | 10.3 | Lung fibroblast TNF alpha + IL-1 beta | 9.2 |
| PBMC PHA-L | 5.6 | Lung fibroblast IL-4 | 15.5 |
| Ramos (B cell) none | 1.4 | Lung fibroblast IL-9 | 12.2 |
| Ramos (B cell) ionomycin | 3.9 | Lung fibroblast IL-13 | 11.0 |
| B lymphocytes PWM | 11.8 | Lung fibroblast IFN gamma | 13.5 |
| B lymphocytes CD40L and IL-4 | 10.9 | Dermal fibroblast CCD1070 rest | 15.7 |
| EOL-1 dbcAMP | 8.1 | Dermal fibroblast CCD1070 TNF alpha | 16.3 |
| EOL-1 dbcAMP PMA/ionomycin | 6.4 | Dermal fibroblast CCD1070 IL-1 beta | 8.9 |
| Dendritic cells none | 4.5 | Dermal fibroblast IFN gamma | 6.0 |
| Dendritic cells LPS | 5.6 | Dermal fibroblast IL-4 | 16.8 |
| Dendritic cells anti-CD40 | 8.5 | IBD Colitis 2 | 1.0 |
| Monocytes rest | 12.0 | IBD Crohn's | 1.4 |
| Monocytes LPS | 7.8 | Colon | 6.0 |
| Macrophages rest | 6.5 | Lung | 8.6 |
| Macrophages LPS | 4.5 | Thymus | 12.9 |
| HUVEC none | 5.9 | Kidney | 5.8 |
| HUVEC starved | 9.0 | | |

CNS_neurodegeneration_v1.0 Summary: Ag2623 No differential expression of this gene is found in Alzheimer's disease brains when compared to control postmortem brains. However, this panel confirms the expression of this gene at moderate level in the CNS in an independent group of patients. Please see Panel 1.3D for a discussion of utility of this gene product in central nervous system function.

Panel 1.3D Summary: Ag2623 Expression of the CG50351-01 gene is highest in a sample derived from fetal liver (CT=27.4). In addition, there is substantial expression of this gene in bone marrow and fetal kidney. Thus, the expression of this gene could be used to distinguish these tissues, and particularly fetal liver, from the other tissues on this panel. Moreover, expression of the CG50351-01 gene in fetal liver and bone marrow suggests that this gene is likely to be involved in hematopoesis. Thus, therapeutic modulation of this gene or its protein product, through the use of small molecule drugs, antibodies or protein therapeutics, might be of benefit in the treatment of hematopoetic diseases.

This gene is also expressed at moderate to low levels in all central nervous system tissues examined, including amygdala, cerebellum, hippocampus, substantia nigra, thalamus, and cerebral cortex. The CG50351-01 gene encodes a protein with homology to erythroid-membrane associated protein (ERMAP). ERMAP potentially acts as a novel adhesion/receptor molecule and this class of protein has been shown to be critical in axon guidance. Therefore, this protein may be useful in enhancing/guiding compensatory synaptogenesis in response to CNS injury (trauma, stroke) or neurodegeneration (Alzheimer's, Parkinson's, or Huntington's disease).

The CG50351-01 gene is expressed in a variety of endocrine and metabolic tissues including adipose, liver, pancreas, skeletal muscle and thyroid. Interestingly, expression of this gene is much higher in fetal liver (CT=27.4) than adult liver (CT=31). Therefore, expression of this gene may be useful to distinguish fetal from adult liver and the protein product may be useful in the treatment of liver degenerative disorders. In addition, this gene and its protein product may be an essential component in normal endocrine and metabolic physiology. Therefore, the therapeutic modulation of this gene or its protein product may be useful in the treatment of endocrine and metabolic diseases, including diabetes and obesity.

Panel 2.2 Summary: Ag2623 This gene is expressed at low to moderate levels in the majority of tissues on this panel. Expression of the CG50351-01 gene is highest in a sample derived from kidney cancer (CT=30.6). Thus, the expression of this gene could be used to distinguish this sample from the other samples on this panel. Moreover, therapeutic modulation of this gene or its protein product, through the use of small molecule drugs, antibodies or protein therapeutics, might be of benefit in the treatment of kidney cancer.

Panel 4D Summary: Ag2623 The CG50351-01 gene is expressed at low levels across the samples of panel 4D. However the highest expression of this transcript is found in KU-812, a basophil cell line (CT=27). Basophils play an important role in allergic diseases and other diseases such as asthma and IBD. Moderate expression of this transcript is also found in the pulmonary muco-epidermoid cell line NCI-H292 (CT=29.1), a model cell line for chronic obstructive pulmonary disease (COPD) and emphysema. This transcript encodes for an ERMAP like molecule, a possible novel adhesion/receptor molecule (reference). Therefore therapeutic modulation of this gene by antibodies, small molecules or protein therapeutics could be useful for the treatement of allergic diseases and also asthma, emphysema, COPD, and IBD (Ye T Z, Gordon C T, Lai Y H, Fujiwara Y, Peters L L, Perkins A C, Chui D H. Ermap, a gene coding for a novel erythroid specific adhesion/receptor membrane protein. Gene 2000 Jan. 25;242(1–2):337–45).

D. NOV4a: Vitelline Membrane Outer Layer Protein I

Expression of NOV4a gene (CG56375-01) was assessed using the primer-probe sets Ag2450 and Ag2536, described in Tables 35–36. Results of the RTQ-PCR runs are shown in Tables 37–38.

TABLE 35

Probe Name Ag2450

| Primers | Sequences | | Length | Start Position |
|---|---|---|---|---|
| Forward | 5'-aagcgagaaagccactaggt-3' | (SED ID NO:205) | 20 | 312 |
| Probe | TET-5'-acaccacagcggctcactccatt-3'-TAMRA | (SEQ ID NO:206) | 23 | 345 |
| Reverse | 5'-gcaatacgcacgtggtagag-3' | (SEQ ID NO:207) | 20 | 390 |

TABLE 36

Probe Name Ag2536

| Primers | Sequences | | Length | Start Position |
|---|---|---|---|---|
| Forward | 5'-aagcgagaaagccactaggta-3' | (SEQ ID NO:208) | 21 | 312 |
| Probe | TET-5'-acaccacagcggctcactccatt-3'-TAMRA | (SEQ ID NO:209) | 23 | 345 |
| Reverse | 5'-gtagagtcccagtctggaagct-3' | (SEQ ID NO:210) | 22 | 374 |

TABLE 37

Panel 1.3D

| Tissue Name | Rel. Exp.(%) Ag2450, Run 160661622 | Rel. Exp.(%) Ag2536, Run 165532773 | Tissue Name | Rel. Exp.(%) Ag2450, Run 160661622 | Rel. Exp.(%) Ag2536, Run 165532773 |
|---|---|---|---|---|---|
| Liver adenocarcinoma | 0.0 | 0.0 | Kidney (fetal) | 3.2 | 0.0 |
| Pancreas | 0.3 | 0.5 | Renal ca. 786-0 | 0.0 | 0.0 |
| Pancreatic ca. CAPAN 2 | 0.0 | 0.0 | Renal ca. A498 | 0.0 | 1.5 |

TABLE 37-continued

Panel 1.3D

| Tissue Name | Rel. Exp.(%) Ag2450, Run 160661622 | Rel. Exp.(%) Ag2536, Run 165532773 | Tissue Name | Rel. Exp.(%) Ag2450, Run 160661622 | Rel. Exp.(%) Ag2536, Run 165532773 |
|---|---|---|---|---|---|
| Adrenal gland | 2.1 | 0.0 | Renal ca. RXF 393 | 0.3 | 0.0 |
| Thyroid | 0.7 | 0.0 | Renal ca. ACHN | 0.0 | 0.0 |
| Salivary gland | 0.9 | 0.0 | Renal ca. UO-31 | 0.0 | 0.0 |
| Pituitary gland | 20.3 | 20.0 | Renal ca. TK-10 | 0.0 | 0.0 |
| Brain (fetal) | 0.3 | 0.0 | Liver | 4.0 | 2.9 |
| Brain (whole) | 0.2 | 1.8 | Liver (fetal) | 5.7 | 22.8 |
| Brain (amygdala) | 0.6 | 4.1 | Liver ca. (hepatoblast) HepG2 | 0.1 | 0.0 |
| Brain (cerebellum) | 0.0 | 0.0 | Lung | 25.9 | 23.8 |
| Brain (hippocampus) | 3.0 | 0.0 | Lung (fetal) | 1.4 | 0.0 |
| Brain (substantia nigra) | 0.5 | 1.2 | Lung ca. (small cell) LX-1 | 0.0 | 0.0 |
| Brain (thalamus) | 1.1 | 1.9 | Lung ca. (small cell) NCI-H69 | 0.0 | 0.0 |
| Cerebral Cortex | 0.5 | 0.0 | Lung ca. (s.cell var.) SHP-77 | 0.0 | 1.8 |
| Spinal cord | 2.1 | 9.8 | Lung ca. (large cell) NCI-H460 | 0.3 | 0.0 |
| glio/astro U87-MG | 0.3 | 0.0 | Lung ca. (non-sm. cell) A549 | 0.0 | 0.0 |
| glio/astro U-118-MG | 0.5 | 2.0 | Lung ca. (non-s. cell) NCI-H23 | 0.0 | 0.0 |
| astrocytoma SW1783 | 0.0 | 0.0 | Lung ca. (non-s.cell) HOP-62 | 0.0 | 0.0 |
| neuro*; met SK-N-AS | 0.3 | 0.0 | Lung ca. (non-s.cl) NCI-H522 | 0.0 | 0.0 |
| astrocytoma SF-539 | 0.0 | 0.0 | Lung ca. (squam.) SW 900 | 0.0 | 0.0 |
| astrocytoma SNB-75 | 0.0 | 0.0 | Lung ca. (squam.) NCI-H596 | 0.0 | 0.0 |
| glioma SNB-19 | 0.0 | 0.0 | Mammary gland | 1.7 | 0.3 |
| glioma U251 | 0.0 | 0.0 | Breast ca.* (pl.ef) MCF-7 | 0.0 | 0.0 |
| glioma SF-295 | 0.3 | 0.0 | Breast ca.* (pl.ef) MDA-MB-231 | 0.2 | 0.0 |
| Heart (fetal) | 3.3 | 5.4 | Breast ca.* (pl.ef) T47D | 0.0 | 0.0 |
| Heart | 0.0 | 0.0 | Breast ca. BT-549 | 0.0 | 0.0 |
| Skeletal muscle (fetal) | 11.9 | 2.7 | Breast ca. MDA-N | 0.0 | 0.0 |
| Skeletal muscle | 0.7 | 4.0 | Ovary | 2.1 | 4.5 |
| Bone marrow | 1.3 | 1.7 | Ovarian ca. OVCAR-3 | 0.0 | 0.0 |
| Thymus | 1.5 | 0.0 | Ovarian ca. OVCAR-4 | 0.0 | 0.0 |
| Spleen | 100.0 | 100.0 | Ovarian ca. OVCAR-5 | 0.0 | 0.0 |
| Lymph node | 1.4 | 9.5 | Ovarian ca. OVCAR-8 | 0.0 | 0.0 |
| Colorectal | 0.9 | 0.0 | Ovarian ca. IGROV-1 | 0.0 | 0.0 |
| Stomach | 1.7 | 1.9 | Ovarian ca.* (ascites) SK-OV-3 | 0.0 | 0.0 |
| Small intestine | 1.8 | 4.2 | Uterus | 0.3 | 0.0 |
| Colon ca. SW480 | 0.0 | 0.0 | Placenta | 0.1 | 0.0 |
| Colon ca.* SW620(SW480 met) | 0.0 | 0.0 | Prostate | 1.1 | 0.0 |
| Colon ca. HT29 | 0.0 | 0.0 | Prostate ca.* (bone met)PC-3 | 1.0 | 0.0 |
| Colon ca. HCT-116 | 0.0 | 0.0 | Testis | 0.7 | 2.0 |
| Colon ca. CaCo-2 | 0.0 | 0.0 | Melanoma Hs688(A).T | 0.3 | 0.0 |
| Colon ca. tissue(ODO3866) | 3.3 | 10.8 | Melanoma* (met) Hs688(B).T | 0.0 | 0.0 |
| Colon ca. HCC-2998 | 0.1 | 0.0 | Melanoma UACC-62 | 0.0 | 0.0 |

TABLE 37-continued

Panel 1.3D

| Tissue Name | Rel. Exp.(%) Ag2450, Run 160661622 | Rel. Exp.(%) Ag2536, Run 165532773 | Tissue Name | Rel. Exp.(%) Ag2450, Run 160661622 | Rel. Exp.(%) Ag2536, Run 165532773 |
|---|---|---|---|---|---|
| Gastric ca.* (liver met) NCI-N87 | 0.3 | 0.0 | Melanoma M14 | 0.0 | 0.0 |
| Bladder | 0.1 | 2.3 | Melanoma LOX IMVI | 0.0 | 0.0 |
| Trachea | 65.5 | 53.6 | Melanoma* (met) SK-MEL-5 | 0.0 | 0.0 |
| Kidney | 0.9 | 1.7 | Adipose | 1.5 | 5.1 |

TABLE 38

Panel 4D

| Tissue Name | Rel. Exp. (%) Ag2450, Run 160836753 | Rel. Exp. (%) Ag2536, Run 164320658 | Tissue Name | Rel. Exp. (%) Ag2450, Run 160836753 | Rel. Exp. (%) Ag2536, Run 164320658 |
|---|---|---|---|---|---|
| Secondary Th1 act | 0.0 | 0.0 | HUVEC IL-1 beta | 0.0 | 0.0 |
| Secondary Th2 act | 0.0 | 0.0 | HUVEC IFN gamma | 0.0 | 0.0 |
| Secondary Tr1 act | 0.0 | 0.0 | HUVEC TNF alpha + INF gamma | 0.0 | 0.0 |
| Secondary Th1 rest | 0.0 | 0.0 | HUVEC TNF alpha + IL4 | 0.0 | 0.0 |
| Secondary Th2 rest | 0.0 | 0.0 | HUVEC IL-11 | 0.0 | 0.0 |
| Secondary Tr1 rest | 0.0 | 0.0 | Lung Microvascular EC none | 0.0 | 0.0 |
| Primary Th1 act | 0.0 | 0.0 | Lung Microvascular EC TNF alpha + IL-1 beta | 0.0 | 0.0 |
| Primary Th2 act | 0.0 | 0.0 | Microvascular Dermal EC none | 0.0 | 4.0 |
| Primary Tr1 act | 0.0 | 0.0 | Microvascular Dermal EC TNF alpha + IL-1 beta | 0.0 | 0.0 |
| Primary Th1 rest | 0.0 | 0.0 | Bronchial epithelium TNF alpha + IL1 beta | 0.0 | 5.5 |
| Primary Th2 rest | 4.2 | 0.0 | Small airway epithelium none | 0.0 | 4.4 |
| Primary Tr1 rest | 0.0 | 0.0 | Small airway epithelium TNF alpha + IL-1 beta | 3.3 | 0.0 |
| CD45RA CD4 lymphocyte act | 0.0 | 0.0 | Coronery artery SMC rest | 0.0 | 0.0 |
| CD45RO CD4 lymphocyte act | 0.0 | 0.0 | Coronery artery SMC TNF alpha + IL-1 beta | 0.0 | 0.0 |
| CD8 lymphocyte act | 0.0 | 0.0 | Astrocytes rest | 0.0 | 0.0 |
| Secondary CD8 lymphocyte rest | 0.0 | 0.0 | Astrocytes TNF alpha + IL-1 beta | 0.0 | 0.0 |
| Secondary CD8 lymphocyte act | 0.0 | 0.0 | KU-812 (Basophil) rest | 0.0 | 0.0 |
| CD4 lymphocyte none | 0.0 | 4.3 | KU-812 (Basophil) PMA/ionomycin | 0.0 | 0.0 |
| 2ry Th1/Th2/Tr1_anti-CD95 CH11 | 0.0 | 0.0 | CCD1106 (Keratinocytes) none | 0.0 | 0.0 |
| LAK cells rest | 12.2 | 4.8 | CCD1106 (Keratinocytes) TNF alpha + IL-1 beta | 0.0 | 0.0 |
| LAK cells IL-2 | 0.0 | 0.0 | Liver cirrhosis | 9.0 | 16.0 |
| LAK cells IL-2 + IL-12 | 3.0 | 0.0 | Lupus kidney | 0.0 | 4.3 |
| LAK cells IL-2 + IFN gamma | 0.0 | 1.4 | NCI-H292 none | 0.0 | 0.0 |
| LAK cells IL-2 + IL-18 | 0.0 | 0.0 | NCI-H292 IL-4 | 0.0 | 3.3 |
| LAK cells PMA/ionomycin | 13.1 | 0.8 | NCI-H292 IL-9 | 4.2 | 0.0 |
| NK Cells IL-2 rest | 0.0 | 0.0 | NCI-H292 IL-13 | 0.0 | 0.0 |

TABLE 38-continued

Panel 4D

| Tissue Name | Rel. Exp. (%) Ag2450, Run 160836753 | Rel. Exp. (%) Ag2536, Run 164320658 | Tissue Name | Rel. Exp. (%) Ag2450, Run 160836753 | Rel. Exp. (%) Ag2536, Run 164320658 |
|---|---|---|---|---|---|
| Two Way MLR 3 day | 100.0 | 100.0 | NCI-H292 IFN gamma | 0.0 | 0.0 |
| Two Way MLR 5 day | 6.3 | 8.5 | HPAEC none | 0.0 | 0.0 |
| Two Way MLR 7 day | 3.3 | 8.6 | HPAEC TNF alpha + IL-1 beta | 0.0 | 0.0 |
| PBMC rest | 0.0 | 4.4 | Lung fibroblast none | 4.3 | 0.0 |
| PBMC PWM | 0.0 | 0.0 | Lung fibroblast TNF alpha + IL- 1 beta | 0.0 | 0.0 |
| PBMC PHA-L | 0.0 | 4.7 | Lung fibroblast IL-4 | 2.9 | 0.0 |
| Ramos (B cell) none | 0.0 | 0.0 | Lung fibroblast IL-9 | 0.0 | 0.0 |
| Ramos (B cell) ionomycin | 0.0 | 0.0 | Lung fibroblast IL-13 | 0.0 | 4.3 |
| B lymphocytes PWM | 0.0 | 0.0 | Lung fibroblast IFN gamma | 0.0 | 0.0 |
| B lymphocytes CD40L and IL-4 | 0.0 | 0.0 | Dermal fibroblast CCD1070 rest | 0.0 | 0.0 |
| EOL-1 dbcAMP | 0.0 | 0.0 | Dermal fibroblast CCD1070 TNF alpha | 0.0 | 0.0 |
| EOL-1 dbcAMP PMA/ionomycin | 0.0 | 0.0 | Dermal fibroblast CCD1070 IL-1 beta | 4.9 | 0.0 |
| Dendritic cells none | 0.0 | 5.1 | Dermal fibroblast IFN gamma | 0.0 | 0.0 |
| Dendritic cells LPS | 0.0 | 0.0 | Dermal fibroblast IL-4 | 0.0 | 0.0 |
| Dendritic cells anti-CD40 | 0.0 | 0.0 | IBD Colitis 2 | 0.0 | 0.0 |
| Monocytes rest | 2.0 | 0.0 | IBD Crohn's | 0.0 | 4.6 |
| Monocytes LPS | 12.4 | 25.9 | Colon | 9.2 | 0.0 |
| Macrophages rest | 5.8 | 34.4 | Lung | 62.4 | 75.8 |
| Macrophages LPS | 19.8 | 15.5 | Thymus | 8.2 | 4.4 |
| HUVEC none | 0.0 | 0.0 | Kidney | 19.3 | 35.1 |
| HUVEC starved | 0.0 | 0.0 | | | |

Panel 1.3D Summary: Ag2450/Ag2536 Expression of the CG56375-01 gene was assessed in two independent runs on Panel 1.3D using identical primer/probe pairs. The results from the two experiments are in excellent agreement. In both experiments, expression of this gene is highest in a sample derived from spleen tissue. In addition, there is substantial expression of this gene in lung, trachea and pituitary gland. Thus, the expression of this gene could be used to distinguish these tissues from the other tissues in the panel.

Panel 4D Summary: Ag2450/Ag2536 Expression of the CG56375-01 gene was assessed in two independent runs on Panel 4D using identical primer/probe pairs. The results from the two experiments are in excellent agreement. In both experiments, expression of this gene is highest in 2-way mixed lymphocyte reaction (MLR) samples (CT=33), but it is also expressed at lower levels in macrophages. In Panel 1.3D, this transcript is detected in spleen, an important site of secondary immune responses, consistent with the expression of this transcript in activated lymphocytes (MLR) and macrophages. Therefore, expression of this gene can be used as a marker of activated lymphocytes. Furthermore, modulation of the activity of this gene or its protein product, using antibodies or protein therapeutics, could be of benefit for inhibiting or preventing allograft rejection in transplantation. Consistent with what is observed in Panel 1.3D, this gene is also expressed at low levels in the lung and could therefore potentially be used as a marker for lung tissues.

E. CG56089-01: MAST205-like (Syntrophin Associated Kinase-like)

Expression of the NOV5 gene CG56089-01 was assessed using the primer-probe set Ag2881, described in Table 39. Results of the RTQ-PCR runs are shown in Tables 40–44.

TABLE 39

Probe Name Ag2881

| Primers | Sequences | | Length | Start Position |
|---|---|---|---|---|
| Forward | 5'-tgaaatgcaacagctatcaaca-3' | (SEQ ID NO:211) | 22 | 2643 |
| Probe | TET-5'-tccaactcttcagatactgaaagcaaca-3'-TAMRA | (SEQ ID NO:212) | 28 | 2665 |
| Reverse | 5'-tttgggaagtaggccagaac-3' | (SEQ ID NO:213) | 20 | 2705 |

TABLE 40

CNS_neurodegeneration_v1.0

| Tissue Name | Rel. Exp.(%) Ag2881, Run 208700817 | Tissue Name | Rel. Exp.(%) Ag2881, Run 208700817 |
|---|---|---|---|
| AD 1 Hippo | 11.4 | Control (Path) 3 Temporal Ctx | 9.2 |
| AD 2 Hippo | 16.7 | Control (Path) 4 Temporal Ctx | 37.6 |
| AD 3 Hippo | 7.2 | AD 1 Occipital Ctx | 16.0 |
| AD 4 Hippo | 6.4 | AD 2 Occipital Ctx (Missing) | 0.0 |
| AD 5 hippo | 91.4 | AD 3 Occipital Ctx | 9.3 |
| AD 6 Hippo | 38.4 | AD 4 Occipital Ctx | 24.7 |
| Control 2 Hippo | 20.0 | AD 5 Occipital Ctx | 22.1 |
| Control 4 Hippo | 9.2 | AD 6 Occipital Ctx | 37.1 |
| Control (Path) 3 Hippo | 6.5 | Control 1 Occipital Ctx | 8.3 |
| AD 1 Temporal Ctx | 18.9 | Control 2 Occipital Ctx | 79.6 |
| AD 2 Temporal Ctx | 25.2 | Control 3 Occipital Ctx | 24.1 |
| AD 3 Temporal Ctx | 6.7 | Control 4 Occipital Ctx | 6.5 |
| AD 4 Temporal Ctx | 19.1 | Control (Path) 1 Occipital Ctx | 55.5 |
| AD 5 Inf Temporal Ctx | 92.7 | Control (Path) 2 Occipital Ctx | 15.8 |
| AD 5 SupTemporal Ctx | 16.4 | Control (Path) 3 Occipital Ctx | 4.5 |
| AD 6 Inf Temporal Ctx | 34.2 | Control (Path) 4 Occipital Ctx | 21.2 |
| AD 6 Sup Temporal Ctx | 39.8 | Control 1 Parietal Ctx | 11.6 |
| Control 1 Temporal Ctx | 6.7 | Control 2 Parietal Ctx | 28.9 |
| Control 2 Temporal Ctx | 37.6 | Control 3 Parietal Ctx | 23.8 |
| Control 3 Temporal Ctx | 20.9 | Control (Path) 1 Parietal Ctx | 100.0 |
| Control 4 Temporal Ctx | 11.8 | Control (Path) 2 Parietal Ctx | 36.3 |
| Control (Path) 1 Temporal Ctx | 41.5 | Control (Path) 3 Parietal Ctx | 6.5 |
| Control (Path) 2 Temporal Ctx | 18.9 | Control (Path) 4 Parietal Ctx | 40.1 |

TABLE 41

Panel 1.3D

| Tissue Name | Rel. Exp.(%) Ag2881, Run 167649413 | Tissue Name | Rel. Exp.(%) Ag2881, Run 167649413 |
|---|---|---|---|
| Liver adenocarcinoma | 13.2 | Kidney (fetal) | 8.6 |
| Pancreas | 0.7 | Renal ca. 786-0 | 0.9 |
| Pancreatic ca. CAPAN 2 | 3.8 | Renal ca. A498 | 2.0 |
| Adrenal gland | 3.1 | Renal ca. RXF 393 | 0.0 |
| Thyroid | 2.1 | Renal ca. ACHN | 2.5 |
| Salivary gland | 3.1 | Renal ca. UO-31 | 0.0 |
| Pituitary gland | 1.8 | Renal ca. TK-10 | 1.3 |
| Brain (fetal) | 9.7 | Liver | 0.8 |
| Brain (whole) | 13.6 | Liver (fetal) | 0.8 |
| Brain (amygdala) | 4.6 | Liver ca. (hepatoblast) HepG2 | 4.8 |
| Brain (cerebellum) | 6.2 | Lung | 5.1 |
| Brain (hippocampus) | 7.4 | Lung (fetal) | 7.4 |
| Brain (substantia nigra) | 3.3 | Lung ca. (small cell) LX-1 | 4.0 |
| Brain (thalamus) | 5.7 | Lung ca. (small cell) NCI-H69 | 13.1 |
| Cerebral Cortex | 28.9 | Lung ca. (s. cell var.) SHP-77 | 21.3 |
| Spinal cord | 3.1 | Lung ca. (large cell) NCI-H460 | 1.0 |
| glio/astro U87-MG | 6.8 | Lung ca. (non-sm. cell) A549 | 21.3 |
| glio/astro U-118-MG | 14.2 | Lung ca. (non-s. cell) NCI-H23 | 0.2 |
| astrocytoma SW1783 | 1.7 | Lung ca. (non-s. cell) HOP-62 | 1.1 |
| neuro*; met SK-N-AS | 4.8 | Lung ca. (non-s. cl) NCI-H522 | 0.3 |
| astrocytoma SF-539 | 0.6 | Lung ca. (squam.) SW 900 | 21.5 |
| astrocytoma SNB-75 | 11.3 | Lung ca. (squam.) NCI-H596 | 23.2 |
| glioma SNB-19 | 1.6 | Mammary gland | 5.6 |

TABLE 41-continued

Panel 1.3D

| Tissue Name | Rel. Exp.(%) Ag2881, Run 167649413 | Tissue Name | Rel. Exp.(%) Ag2881, Run 167649413 |
|---|---|---|---|
| glioma U251 | 11.5 | Breast ca.* (pl. ef) MCF-7 | 21.0 |
| glioma SF-295 | 3.1 | Breast ca.* (pl. ef) MDA-MB-231 | 5.5 |
| Heart (fetal) | 6.4 | Breast ca.* (pl. ef) T47D | 11.0 |
| Heart | 7.1 | Breast ca. BT-549 | 2.1 |
| Skeletal muscle (fetal) | 5.6 | Breast ca. MDA-N | 0.0 |
| Skeletal muscle | 4.7 | Ovary | 10.2 |
| Bone marrow | 1.1 | Ovarian ca. OVCAR-3 | 1.3 |
| Thymus | 6.8 | Ovarian ca. OVCAR-4 | 1.0 |
| Spleen | 1.6 | Ovarian ca. OVCAR-5 | 31.4 |
| Lymph node | 3.0 | Ovarian ca. OVCAR-8 | 0.4 |
| Colorectal | 100.0 | Ovarian ca. IGROV-1 | 1.4 |
| Stomach | 1.8 | Ovarian ca.* (ascites) SK-OV-3 | 4.6 |
| Small intestine | 0.9 | Uterus | 3.4 |
| Colon ca. SW480 | 1.4 | Placenta | 1.8 |
| Colon ca.* SW620 (SW480 met) | 13.8 | Prostate | 2.0 |
| Colon ca. HT29 | 1.4 | Prostate ca.* (bone met) PC-3 | 0.0 |
| Colon ca. HCT-116 | 0.0 | Testis | 1.8 |
| Colon ca. CaCo-2 | 4.4 | Melanoma Hs688(A).T | 0.9 |
| Colon ca. tissue (ODO3866) | 4.0 | Melanoma* (met) Hs688(B).T | 2.2 |
| Colon ca. HCC-2998 | 2.5 | Melanoma UACC-62 | 1.1 |
| Gastric ca.* (liver met) NCI-N87 | 6.4 | Melanoma M14 | 0.0 |
| Bladder | 14.3 | Melanoma LOX IMVI | 12.2 |
| Trachea | 1.5 | Melanoma* (met) SK-MEL-5 | 1.4 |
| Kidney | 8.4 | Adipose | 24.8 |

TABLE 42

Panel 2.2

| Tissue Name | Rel. Exp.(%) Ag2881, Run 175119671 | Tissue Name | Rel. Exp.(%) Ag2881, Run 175119671 |
|---|---|---|---|
| Normal Colon | 17.2 | Kidney Margin (OD04348) | 100.0 |
| Colon cancer (OD06064) | 24.3 | Kidney malignant cancer (OD06204B) | 32.8 |
| Colon Margin (OD06064) | 16.6 | Kidney normal adjacent tissue (OD06204E) | 23.3 |
| Colon cancer (OD06159) | 1.9 | Kidney Cancer (OD04450-01) | 8.4 |
| Colon Margin (OD06159) | 8.5 | Kidney Margin (OD04450-03) | 21.3 |
| Colon cancer (OD06297-04) | 2.8 | Kidney Cancer 8120613 | 0.4 |
| Colon Margin (OD06297-015) | 24.5 | Kidney Margin 8120614 | 14.3 |
| CC Gr.2 ascend colon (ODO3921) | 4.5 | Kidney Cancer 9010320 | 2.7 |
| CC Margin (ODO3921) | 4.5 | Kidney Margin 9010321 | 4.8 |
| Colon cancer metastasis (OD06104) | 4.1 | Kidney Cancer 8120607 | 7.6 |
| Lung Margin (OD06104) | 6.3 | Kidney Margin 8120608 | 2.6 |
| Colon mets to lung (OD04451-01) | 3.5 | Normal Uterus | 21.6 |
| Lung Margin (OD04451-02) | 25.2 | Uterine Cancer 064011 | 19.1 |
| Normal Prostate | 9.9 | Normal Thyroid | 2.0 |
| Prostate Cancer (OD04410) | 1.4 | Thyroid Cancer 064010 | 6.9 |
| Prostate Margin (OD04410) | 11.9 | Thyroid Cancer A302152 | 18.0 |
| Normal Ovary | 19.9 | Thyroid Margin A302153 | 3.6 |
| Ovarian cancer (OD06283-03) | 7.9 | Normal Breast | 29.3 |
| Ovarian Margin (OD06283-07) | 29.1 | Breast Cancer (OD04566) | 3.8 |
| Ovarian Cancer 064008 | 20.7 | Breast Cancer 1024 | 12.6 |
| Ovarian cancer (OD06145) | 1.7 | Breast Cancer (OD04590-01) | 35.8 |

TABLE 42-continued

Panel 2.2

| Tissue Name | Rel. Exp.(%) Ag2881, Run 175119671 | Tissue Name | Rel. Exp.(%) Ag2881, Run 175119671 |
|---|---|---|---|
| Ovarian Margin (OD06145) | 21.5 | Breast Cancer Mets (OD04590-03) | 31.6 |
| Ovarian cancer (OD06455-03) | 4.0 | Breast Cancer Metastasis (OD04655-05) | 59.9 |
| Ovarian Margin (OD06455-07) | 17.0 | Breast Cancer 064006 | 4.7 |
| Normal Lung | 17.9 | Breast Cancer 9100266 | 20.9 |
| Invasive poor diff. lung adeno (ODO4945-01 | 5.8 | Breast Margin 9100265 | 12.2 |
| Lung Margin (ODO4945-03) | 27.9 | Breast Cancer A209073 | 6.6 |
| Lung Malignant Cancer (OD03126) | 9.9 | Breast Margin A2090734 | 24.8 |
| Lung Margin (OD03126) | 13.6 | Breast cancer (OD06083) | 11.5 |
| Lung Cancer (OD05014A) | 15.7 | Breast cancer node metastasis (OD06083) | 7.3 |
| Lung Margin (OD05014B) | 37.1 | Normal Liver | 27.7 |
| Lung cancer (OD06081) | 11.6 | Liver Cancer 1026 | 2.7 |
| Lung Margin (OD06081) | 12.6 | Liver Cancer 1025 | 7.4 |
| Lung Cancer (OD04237-01) | 2.5 | Liver Cancer 6004-T | 12.9 |
| Lung Margin (OD04237-02) | 57.8 | Liver Tissue 6004-N | 0.0 |
| Ocular Melanoma Metastasis | 3.3 | Liver Cancer 6005-T | 2.9 |
| Ocular Melanoma Margin (Liver) | 14.0 | Liver Tissue 6005-N | 12.2 |
| Melanoma Metastasis | 2.0 | Liver Cancer 064003 | 4.8 |
| Melanoma Margin (Lung) | 29.3 | Normal Bladder | 13.4 |
| Normal Kidney | 9.4 | Bladder Cancer 1023 | 4.0 |
| Kidney Ca, Nuclear grade 2 (OD04338) | 52.9 | Bladder Cancer A302173 | 4.2 |
| Kidney Margin (OD04338) | 10.6 | Normal Stomach | 32.3 |
| Kidney Ca Nuclear grade 1/2 (OD04339) | 12.5 | Gastric Cancer 9060397 | 1.2 |
| Kidney Margin (OD04339) | 22.2 | Stomach Margin 9060396 | 2.5 |
| Kidney Ca, Clear cell type (OD04340) | 19.8 | Gastric Cancer 9060395 | 10.4 |
| Kidney Margin (OD04340) | 20.6 | Stomach Margin 9060394 | 13.7 |
| Kidney Ca, Nuclear grade 3 (OD04348) | 5.5 | Gastric Cancer 064005 | 4.3 |

TABLE 43

Panel 4D

| Tissue Name | Rel. Exp.(%) Ag2881, Run 164311037 | Tissue Name | Rel. Exp.(%) Ag2881, Run 164311037 |
|---|---|---|---|
| Secondary Th1 act | 5.8 | HUVEC IL-1 beta | 9.8 |
| Secondary Th2 act | 8.1 | HUVEC IFN gamma | 21.2 |
| Secondary Tr1 act | 7.5 | HUVEC TNF alpha + IFN gamma | 23.5 |
| Secondary Th1 rest | 2.5 | HUVEC TNF alpha + IL4 | 16.3 |
| Secondary Th2 rest | 3.8 | HUVEC IL-11 | 5.8 |
| Secondary Tr1 rest | 3.4 | Lung Microvascular EC none | 11.3 |
| Primary Th1 act | 3.7 | Lung Microvascular EC TNF alpha + IL-1 beta | 15.3 |
| Primary Th2 act | 3.3 | Microvascular Dermal EC none | 23.7 |
| Primary Tr1 act | 6.5 | Microsvasular Dermal EC TNF alpha + IL-1 beta | 15.7 |
| Primary Th1 rest | 18.3 | Bronchial epithelium TNF alpha + IL1-beta | 29.3 |
| Primary Th2 rest | 11.8 | Small airway epithelium none | 4.3 |
| Primary Tr1 rest | 4.3 | Small airway epithelium TNF alpha + IL-1 beta | 100.0 |
| CD45RA CD4 lymphocyte act | 1.1 | Coronery artery SMC rest | 5.5 |
| CD45RO CD4 lymphocyte act | 4.7 | Coronery artery SMC TNF alpha + IL-1 beta | 3.3 |
| CD8 lymphocyte act | 0.9 | Astrocytes rest | 2.4 |
| Secondary CD8 lymphocyte rest | 6.7 | Astrocytes TNF alpha + IL-1 beta | 2.1 |

TABLE 43-continued

Panel 4D

| Tissue Name | Rel. Exp.(%) Ag2881, Run 164311037 | Tissue Name | Rel. Exp.(%) Ag2881, Run 164311037 |
|---|---|---|---|
| Secondary CD8 lymphocyte act | 2.4 | KU-812 (Basophil) rest | 5.1 |
| CD4 lymphocyte none | 2.5 | KU-812 (Basophil) PMA/ionomycin | 27.0 |
| 2ry Th1/Th2/Tr1_anti-CD95 CH11 | 4.0 | CCD1106 (Keratinocytes) none | 6.0 |
| LAK cells rest | 1.3 | CCD1106 (Keratinocytes) TNF alpha + IL-1 beta | 9.0 |
| LAK cells IL-2 | 2.6 | Liver cirrhosis | 1.8 |
| LAK cells IL-2 + IL-12 | 2.5 | Lupus kidney | 0.9 |
| LAK cells IL-2 + IFN gamma | 6.2 | NCI-H292 none | 28.5 |
| LAK cells IL-2 + IL-18 | 5.0 | NCI-H292 IL-4 | 30.6 |
| LAK cells PMA/ionomycin | 2.5 | NCI-H292 IL-9 | 34.4 |
| NK Cells IL-2 rest | 1.2 | NCI-H292 IL-13 | 14.7 |
| Two Way MLR 3 day | 1.3 | NCI-H292 IFN gamma | 24.5 |
| Two Way MLR 5 day | 1.8 | HPAEC none | 7.6 |
| Two Way MLR 7 day | 2.0 | HPAEC TNF alpha + IL-1 beta | 15.1 |
| PBMC rest | 1.2 | Lung fibroblast none | 4.4 |
| PBMC PWM | 24.5 | Lung fibroblast TNF alpha + IL-1 beta | 2.1 |
| PBMC PHA-L | 12.2 | Lung fibroblast IL-4 | 4.8 |
| Ramos (B cell) none | 1.6 | Lung fibroblast IL-9 | 4.1 |
| Ramos (B cell) ionomycin | 14.5 | Lung fibroblast IL-13 | 2.4 |
| B lymphocytes PWM | 26.2 | Lung fibroblast IFN gamma | 12.2 |
| B lymphocytes CD40L and IL-4 | 4.3 | Dermal fibroblast CCD1070 rest | 2.3 |
| EOL-1 dbcAMP | 0.0 | Dermal fibroblast CCD1070 TNF alpha | 8.6 |
| EOL-1 dbcAMP PMA/ionomycin | 0.1 | Dermal fibroblast CCD1070 IL-1 beta | 0.5 |
| Dendritic cells none | 0.7 | Dermal fibroblast IFN gamma | 1.2 |
| Dendritic cells LPS | 0.0 | Dermal fibroblast IL-4 | 1.9 |
| Dendritic cells anti-CD40 | 0.9 | IBD Colitis 2 | 0.2 |
| Monocytes rest | 0.1 | IBD Crohn's | 0.4 |
| Monocytes LPS | 0.4 | Colon | 3.5 |
| Macrophages rest | 0.8 | Lung | 7.6 |
| Macrophages LPS | 0.2 | Thymus | 14.9 |
| HUVEC none | 15.1 | Kidney | 21.3 |
| HUVEC starved | 49.3 | | |

TABLE 44

Panel 5 Islet

| Tissue Name | Rel. Exp. (%) Ag2881, Run 233070520 | Rel. Exp. (%) Ag2881, Run 233682397 | Tissue Name | Rel. Exp. (%) Ag2881, Run 233070520 | Rel. Exp. (%) Ag2881, Run 233682397 |
|---|---|---|---|---|---|
| 97457_Patient-02go_adipose | 50.0 | 39.8 | 94709_Donor 2 AM - A_adipose | 12.7 | 10.7 |
| 97476 Patient-07sk_skeletal muscle | 12.6 | 15.0 | 94710_Donor 2 AM - B_adipose | 7.8 | 4.1 |
| 97477_Patient-07ut_uterus | 24.5 | 28.7 | 94711_Donor 2 AM - C_adipose | 2.5 | 1.8 |
| 97478_Patient-07pl_placenta | 49.0 | 51.8 | 94712_Donor 2 AD - A_adipose | 21.0 | 15.3 |
| 99167_Bayer Patient 1 | 100.0 | 100.0 | 94713_Donor 2 AD - B_adipose | 13.9 | 20.4 |
| 97482_Patient-08ut_uterus | 23.2 | 20.6 | 94714_Donor 2 AD - C_adipose | 21.6 | 15.6 |
| 97483_Patient-08pl_placenta | 48.6 | 40.9 | 94742_Donor 3 U - A_Mesenchymal Stem Cells | 3.0 | 2.5 |
| 97486_Patient-09sk_skeletal muscle | 4.0 | 6.0 | 94743_Donor 3 U - B_Mesenchymal Stem Cells | 6.3 | 4.7 |
| 97487_Patient-09ut_uterus | 13.9 | 41.8 | 94730_Donor 3 AM - A_adipose | 15.7 | 12.6 |

TABLE 44-continued

Panel 5 Islet

| Tissue Name | Rel. Exp. (%) Ag2881, Run 233070520 | Rel. Exp. (%) Ag2881, Run 233682397 | Tissue Name | Rel. Exp. (%) Ag2881, Run 233070520 | Rel. Exp. (%) Ag2881, Run 233682397 |
|---|---|---|---|---|---|
| 97488_Patient-09pl_placenta | 29.1 | 29.5 | 94731_Donor 3 AM - B_adipose | 8.1 | 2.6 |
| 97492_Patient-10ut_uterus | 19.1 | 28.1 | 94732_Donor 3 AM - C_adipose | 10.4 | 6.6 |
| 97493_Patient-10pl_placenta | 82.9 | 94.0 | 94733_Donor 3 AD - A_adipose | 14.3 | 18.0 |
| 97495_Patient-11go_adipose | 41.2 | 42.0 | 94734_Donor 3 AD - B_adipose | 4.9 | 4.8 |
| 97496_Patient-11sk_skeletal muscle | 18.7 | 17.9 | 94735_Donor 3 AD - C_adipose | 11.7 | 13.2 |
| 97497_Patient-11ut_uterus | 49.3 | 49.7 | 77138_Liver_HepG2untreated | 46.0 | 42.0 |
| 97498_Patient-11pl_placenta | 25.9 | 35.1 | 73556_Heart_Cardiac stromal cells (primary) | 96.6 | 72.2 |
| 97500_Patient-12go_adipose | 42.0 | 39.5 | 81735_Small Intestine | 29.5 | 34.6 |
| 97501_Patient-12sk_skeletal muscle | 24.3 | 44.4 | 72409_Kidney_Proximal Convoluted Tubule | 8.8 | 4.4 |
| 97502_Patient-12ut_uterus | 42.0 | 39.2 | 82685_Small intestine_Duodenum | 1.8 | 1.3 |
| 97503_Patient-12pl_placenta | 24.1 | 18.3 | 90650_Adrenal_Adrenocortical adenoma | 16.4 | 13.0 |
| 94721_Donor 2 U-A_ Mesenchymal Stem Cells | 5.1 | 8.8 | 72410_Kidney_HRCE | 17.2 | 17.4 |
| 94722_Donor 2 U-B_ Mesenchymal Stem Cells | 2.2 | 4.0 | 72411_Kidney_HRE | 25.7 | 28.7 |
| 94723_Donor 2 U-C_ Mesenchymal Stem Cells | 3.5 | 4.9 | 73139_Uterus_Uterine smooth muscle cells | 11.5 | 4.5 |

CNS_neurodegeneration_v1.0 Summary: Ag2881 The results from this experiment confirm the expression of this gene at moderate level in the CNS in an independent group of patients. However, no differential expression of the CG56089-01 gene is found between Alzheimer's disease and control postmortem brains on this panel. Please see Panel 1.3D for a discussion of utility.

Panel 1.3D Summary: Ag2881 Expression of the CG56089-01 gene is highest in a sample derived from normal colon tissue (CT=27.3). Thus, expression of this gene could be used to distinguish colon tissue from the other samples in the panel. In addition, there is moderate expression of this gene in a number of lung cancer cell lines (CTs=29.5–31). Therefore, therapeutic modulation of this gene or its protein product, through the use of small molecule drugs, antibodies or protein therapeutics, might be of benefit in the treatment of lung cancer. This gene is also expressed at moderate levels in all CNS regions examined, including in amygdala, cerebellum, hippocampus, substanti nigra, cerebral cortex, thalamus and spinal cord, suggesting a potential role in normal function of the central nervous system.

Among tissues with metabolic or endocrine function, this gene is expressed at moderate levels in adipose, heart and skeletal muscle and at low levels in pancreas, adrenal gland, thyroid, pituitary gland, and liver. The CG56089-01 gene is homologous to MAST205, which was originally identified as microtubule-associated serine/threonine protein kinase from mouse testis (ref. 1); the MAST205 protein is also referred to as syntrophin associated kinase. MAST205 interacts with b2-syntrophin via PDZ domain interactions (ref. 2) and co-localizes at neuromuscular junctions with b2-syntrophin. The activity of syntrophin associated S/T kinases is regulated by phosphorylation. Therefore, the homologous CG56089-01 protein may be of utility in the treatment of muscular dystrophy or other neuromuscular disorders. Furthermore, the relatively high expression of this gene in adipose and skeletal muscle suggests that modulation of the activity of this gene or its protein product, using protein therapeutics, antibodies or small molecule drugs, could be of use in the treatment of both obesity and type II diabetes (Walden P D, Millette C F. 1996. Increased activity associated with the MAST205 protein kinase complex during mammalian spermiogenesis. Biol Reprod 55:1039–44; Lumeng C, Phelps S, Crawford G E, Walden P D, Barald K, Chamberlain J S. Interactions between beta 2-syntrophin and a family of microtubule-associated serine/threonine kinases. Nat Neurosci 1999 Jul; 2(7):611–7).

Panel 2.2 Summary: Ag2881 Expression of the CG56089-01 gene is highest is a sample derived from normal kidney tissue adjacent to a kidney cancer (CT=30.3). In addition, there is substantial expression in a number of other normal tissues, including two samples derived from normal tissue surrounding lung cancers, normal stomach, normal breast and normal colon. Thus, the expression of this gene could be used to distinguish these tissues from the other tissues on this panel. Moreover, therapeutic modulation of this gene or its protein product, through the use of small molecule drugs, antibodies or protein therapeutics, might be of benefit for the treatment of lung cancer, breast cancer, kidney cancer or colon cancer.

Panel 4D Summary: Ag2881 The CG56089-01 gene is expressed at moderate to low levels across the majority of samples on this panel. However, this gene is highly expressed in small airway epithelium treated with the pro-inflammatory cytokines TNF-a and IL-1b (CT=26.4), in human umbilical vein epithelial cells (HUVEC), in the muco-epidermoid cell line H292, and bronchial epithelium treated with TNF-a and IL-1.

The CG56089-01 gene encodes a protein with homology to MAST205, a microtubule-associated serine/threonine kinase, that has a PDZ domain that allows interaction with beta 2-syntrophin. It is possible that this protein can interact with other proteins through its PDZ domain including, for example, synthenin, a protein that plays a role in cytokine regulation (ref. 1). Therefore, modulation of the expression or activity of the CG56089-01 gene product by small molecule drugs could be useful to prevent or reduce the symptoms associated with lung inflammatory reactions occurring in chronic obstructive pulmonary disease, asthma, and emphysema. Since this transcript is also found at lower levels in activated T and B cells, therapeutic modulation of this gene or its protein product using protein therapeutics, monoclonal antibodies or small molecule drugs, could also be used to treat the symptoms associated with autoimmune and inflammatory diseases, such as inflammatory bowel disease, systemic lupus erythematosus, or rheumatoid arthritis (Geijsen N, Uings I J, Pals C, Armstrong J, McKinnon M, Raaijmakers J A, Lammers J W, Koenderman L, Coffer P J. Cytokine-specific transcriptional regulation through an IL-5Ralpha interacting protein. Science 2001 Aug. 10;293 (5532):1136–8).

Panel 5 Islet Summary: Ag2881 The CG56089-01 gene is expressed at low levels (CTs=32–35) in the various types of adipose and skeletal muscle collected from the different patient and donor groups represented on this panel, further indicating an importance for this gene in the regulation of metabolism and energy balance. The gene is also expressed in human islets indicating a potential importance in insulin secretion. This gene localizes to the type II diabetes QTL at 5q12.3. When phosphorylated, b2-syntrophin may negatively influence insulin secretion (See Panel 1.3D for a description), suggesting that therapeutic modulation of the CG56089-01 syntrophin associated kinase-like gene or its protein product, using protein therapeutics, antibodies or small molecule drugs, may influence insulin secretion in type II diabetes.

F. NOV6: Kilon-like

Expression of the NOV6 gene (CG56087-01) was assessed using the primer-probe sets Ag2847 and Ag2880, described in Tables 45–46. Results of the RTQ-PCR runs are shown in Tables 47–51.

TABLE 45

| Probe Name Ag2847 | | | | |
|---|---|---|---|---|
| Primers | Sequences | | Length | Start Position |
| Forward | 5'-agggactacagcctccagatac-3' | (SEQ ID NO:214) | 22 | 311 |
| Probe | TET-5'-atggcccatacacgtgttctgttcag-3'-TAMRA | (SEQ ID NO:215) | 26 | 354 |
| Reverse | 5'-cattgttctgggtgtatgttga-3' | (SEQ ID NO:216) | 22 | 382 |

TABLE 46

| Probe Name Ag2880 | | | | |
|---|---|---|---|---|
| Primers | Sequences | | Length | Start Position |
| Forward | 5'-gctggtaccttgtgttgacact-3' | (SEQ ID NO:217) | 22 | 1011 |
| Probe | TET-5'-ccagcatattctacctgaagaatgcca-3'-TAMRA | (SEQ ID NO:218) | 27 | 1044 |
| Reverse | 5'-aaagccttttatgggtctttga-3' | (SEQ ID NO:219) | 22 | 1084 |

TABLE 47

| CNS_neurodegeneration_v1.0 | | | | | |
|---|---|---|---|---|---|
| Tissue Name | Rel. Exp.(%) Ag2847, Run 208699894 | Rel. Exp.(%) Ag2880, Run 209058910 | Tissue Name | Rel. Exp.(%) Ag2847, Run 208699894 | Rel. Exp.(%) Ag2880, Run 209058910 |
| AD 1 Hippo | 5.6 | 2.4 | Control 3 Temporal Ctx | 1.9 | 0.3 |
| AD 2 Hippo | 13.9 | 10.5 | Control (Path) 4 Temporal Ctx | 29.3 | 12.8 |
| AD 3 Hippo | 2.7 | 1.1 | AD 1 Occipital Ctx | 11.0 | 4.6 |
| AD 4 Hippo | 3.1 | 0.5 | AD 2 Occipital Ctx (Missing) | 0.0 | 0.0 |

TABLE 47-continued

CNS_neurodegeneration_v1.0

| Tissue Name | Rel. Exp.(%) Ag2847, Run 208699894 | Rel. Exp.(%) Ag2880, Run 209058910 | Tissue Name | Rel. Exp.(%) Ag2847, Run 208699894 | Rel. Exp.(%) Ag2880, Run 209058910 |
|---|---|---|---|---|---|
| AD 5 Hippo | 84.1 | 100.0 | AD 3 Occipital Ctx | 1.9 | 1.0 |
| AD 6 Hippo | 19.9 | 19.8 | AD 4 Occipital Ctx | 12.2 | 2.7 |
| Control 2 Hippo | 15.5 | 12.9 | AD 5 Occipital Ctx | 39.0 | 18.9 |
| Control 4 Hippo | 2.1 | 1.4 | AD 6 Occipital Ctx | 24.0 | 46.7 |
| Control (Path) 3 Hippo | 1.3 | 0.4 | Control 1 Occipital Ctx | 0.7 | 0.3 |
| AD 1 Temporal Ctx | 4.6 | 2.0 | Control 2 Occipital Ctx | 50.3 | 66.4 |
| AD 2 Temporal Ctx | 22.8 | 13.9 | Control 3 Occipital Ctx | 12.6 | 3.9 |
| AD 3 Temporal Ctx | 2.1 | 0.7 | Control 4 Occipital Ctx | 1.6 | 1.0 |
| AD 4 Temporal Ctx | 15.0 | 4.0 | Control (Path) 1 Occipital Ctx | 69.3 | 93.3 |
| AD 5 Inf Temporal Ctx | 100.0 | 81.8 | Control (Path) 2 Occipital Ctx | 9.8 | 3.6 |
| AD 5 Sup Temporal Ctx | 20.3 | 16.6 | Control (Path) 3 Occipital Ctx | 0.6 | 0.3 |
| AD 6 Inf Temporal Ctx | 24.3 | 28.7 | Control (Path) 4 Occipital Ctx | 11.2 | 4.7 |
| AD 6 Sup Temporal Ctx | 24.5 | 29.3 | Control 1 Parietal Ctx | 2.5 | 0.6 |
| Control 1 Temporal Ctx | 1.6 | 0.4 | Control 2 Parietal Ctx | 19.3 | 13.3 |
| Control 2 Temporal Ctx | 30.1 | 35.6 | Control 3 Parietal Ctx | 12.6 | 4.9 |
| Control 3 Temporal Ctx | 7.3 | 2.6 | Control (Path) 1 Parietal Ctx | 62.9 | 92.7 |
| Control 3 Temporal Ctx | 2.6 | 1.3 | Control (Path) 2 Parietal Ctx | 15.5 | 9.5 |
| Control (Path) 1 Temporal Ctx | 44.1 | 54.7 | Control (Path) 3 Parietal Ctx | 1.2 | 0.3 |
| Control (Path) 2 Temporal Ctx | 22.7 | 15.7 | Control (Path) 4 Parietal Ctx | 40.1 | 27.0 |

TABLE 48

Panel 1.3D

| Tissue Name | Rel. Exp.(%) Ag2847, Run 161930455 | Rel. Exp.(%) Ag2880, Run 159996472 | Tissue Name | Rel. Exp.(%) Ag2847, Run 161930455 | Rel. Exp.(%) Ag2880, Run 159996472 |
|---|---|---|---|---|---|
| Liver adenocarcinoma | 1.2 | 0.3 | Kidney (fetal) | 0.9 | 1.3 |
| Pancreas | 0.5 | 0.5 | Renal ca. 786-0 | 0.2 | 0.3 |
| Pancreatic ca. CAPAN 2 | 0.0 | 0.0 | Renal ca. A498 | 0.5 | 0.5 |
| Adrenal gland | 1.1 | 1.8 | Renal ca. RXF 393 | 0.0 | 0.0 |
| Thyroid | 1.4 | 1.4 | Renal ca. ACHN | 0.5 | 0.3 |
| Salivary gland | 0.3 | 03 | Renal ca. UO-31 | 4.3 | 4.1 |
| Pituitary gland | 2.6 | 6.0 | Renal ca. TK-10 | 0.0 | 0.1 |
| Brain (fetal) | 4.8 | 8.7 | Liver | 0.0 | 0.1 |
| Brain (whole) | 19.8 | 21.5 | Liver (fetal) | 0.1 | 0.1 |
| Brain (amygdala) | 20.9 | 31.9 | Liver ca. (hepatoblast) HepG2 | 0.0 | 0.0 |
| Brain (cerebellum) | 25.0 | 15.2 | Lung | 2.2 | 4.2 |
| Brain (hippocampus) | 38.4 | 100.0 | Lung (fetal) | 1.2 | 0.4 |
| Brain (substantia nigra) | 3.6 | 4.0 | Lung ca. (small cell) LX-1 | 0.0 | 0.0 |
| Brain (thalamus) | 5.9 | 9.2 | Lung ca. (small cell) NCI-H69 | 0.3 | 0.6 |

TABLE 48-continued

Panel 1.3D

| Tissue Name | Rel. Exp.(%) Ag2847, Run 161930455 | Rel. Exp.(%) Ag2880, Run 159996472 | Tissue Name | Rel. Exp.(%) Ag2847, Run 161930455 | Rel. Exp.(%) Ag2880, Run 159996472 |
|---|---|---|---|---|---|
| Cerebral Cortex | 100.0 | 40.3 | Lung ca. (s.cell var.) SHP-77 | 1.6 | 1.3 |
| Spinal cord | 11.1 | 2.7 | Lung ca. (large cell)NCI-H460 | 0.2 | 0.1 |
| glio/astro U87-MG | 1.3 | 0.3 | Lung ca. (non-sm. cell) A549 | 0.0 | 0.0 |
| glio/astro U-118-MG | 9.7 | 20.7 | Lung ca. (non-s.cell) NCI-H23 | 0.1 | 0.0 |
| astrocytoma SW1783 | 2.9 | 1.5 | Lung ca. (non-s.cell) HOP-62 | 2.0 | 1.3 |
| neuro*; met SK-N-AS | 0.5 | 2.4 | Lung ca. (non-s.cl) NCI-H522 | 0.1 | 0.0 |
| astrocytoma SF-539 | 0.8 | 0.4 | Lung ca. (squam.) SW 900 | 0.0 | 0.0 |
| astrocytoma SNB-75 | 0.2 | 0.1 | Lung ca. (squam.) NCI-H596 | 0.3 | 0.2 |
| glioma SNB-19 | 0.2 | 0.2 | Mammary gland | 1.4 | 3.8 |
| glioma U251 | 0.8 | 0.4 | Breast ca.* (pl.ef) MCF-7 | 0.0 | 0.0 |
| glioma SF-295 | 0.0 | 0.0 | Breast ca.* (pl.ef) MDA-MB-231 | 0.7 | 3.8 |
| Heart (fetal) | 5.4 | 1.0 | Breast ca.* (pl.ef) T47D | 0.0 | 0.0 |
| Heart | 4.7 | 1.9 | Breast ca. BT-549 | 0.2 | 2.0 |
| Skeletal muscle (fetal) | 22.7 | 6.8 | Breast ca. MDA-N | 0.0 | 0.0 |
| Skeletal muscle | 3.8 | 0.6 | Ovary | 5.2 | 1.4 |
| Bone marrow | 0.3 | 0.6 | Ovarian ca. OVCAR-3 | 0.9 | 1.0 |
| Thymus | 8.2 | 1.3 | Ovarian ca. OVCAR-4 | 0.0 | 0.0 |
| Spleen | 0.1 | 0.1 | Ovarian ca. OVCAR-5 | 0.0 | 0.0 |
| Lymph node | 0.7 | 0.6 | Ovarian ca. OVCAR-8 | 1.3 | 1.1 |
| Colorectal | 9.0 | 1.7 | Ovarian ca. IGROV-1 | 0.0 | 0.0 |
| Stomach | 2.2 | 4.0 | Ovarian ca.* (ascites) SK-OV-3 | 0.0 | 0.3 |
| Small intestine | 5.6 | 7.1 | Uterus | 2.2 | 2.5 |
| Colon ca. SW480 | 0.0 | 0.0 | Placenta | 0.5 | 0.6 |
| Colon ca.* SW620(SW480 met) | 0.0 | 0.0 | Prostate | 0.7 | 0.3 |
| Colon ca. HT29 | 0.0 | 0.0 | Prostate ca.* (bone met)PC-3 | 1.4 | 1.7 |
| Colon ca. HCT-116 | 0.0 | 0.0 | Testis | 1.7 | 1.2 |
| Colon ca. CaCo-2 | 0.0 | 0.0 | Melanoma Hs688(A).T | 5.4 | 2.4 |
| Colon ca. tissue(ODO3866) | 2.5 | 0.9 | Melanoma* (met) Hs688(B).T | 5.5 | 2.3 |
| Colon ca. HCC-2998 | 0.0 | 0.0 | Melanoma UACC-62 | 0.0 | 0.0 |
| Gastric ca.* (liver met) NCI-N87 | 0.0 | 0.4 | Melanoma M14 | 0.0 | 0.4 |
| Bladder | 3.3 | 0.3 | Melanoma LOX IMVI | 0.0 | 0.1 |
| Trachea | 3.9 | 4.0 | Melanoma* (met) SK-MEL-5 | 0.1 | 0.0 |
| Kidney | 2.3 | 0.4 | Adipose | 8.6 | 3.2 |

TABLE 49

Panel 2D

| Tissue Name | Rel. Exp.(%) Ag2847, Run 161930456 | Rel. Exp.(%) Ag2880, Run 159996526 | Tissue Name | Rel. Exp.(%) Ag2847, Run 161930456 | Rel. Exp.(%) Ag2880, Run 159996526 |
|---|---|---|---|---|---|
| Normal Colon | 100.0 | 100.0 | Kidney Margin 8120608 | 7.2 | 2.3 |
| CC Well to Mod Diff (ODO3866) | 2.4 | 4.2 | Kidney Cancer 8120613 | 0.0 | 0.0 |
| CC Margin (ODO3866) | 19.1 | 26.6 | Kidney Margin 8120614 | 10.7 | 3.0 |
| CC Gr.2 rectosigmoid (ODO3868) | 2.7 | 3.4 | Kidney Cancer 9010320 | 1.3 | 0.7 |
| CC Margin (ODO3868) | 15.4 | 17.2 | Kidney Margin 9010321 | 9.6 | 5.1 |
| CC Mod Diff (ODO3920) | 1.6 | 0.7 | Normal Uterus | 17.9 | 12.9 |
| CC Margin (ODO3920) | 29.5 | 23.0 | Uterus Cancer 064011 | 43.2 | 22.7 |
| CC Gr.2 ascend colon (ODO3921) | 17.6 | 17.9 | Normal Thyroid | 7.4 | 12.6 |
| CC Margin (ODO3921) | 18.2 | 22.4 | Thyroid Cancer 064010 | 2.0 | 1.0 |
| CC from Partial Hepatectomy (ODO4309) Mets | 0.3 | 1.0 | Thyroid Cancer A302152 | 1.2 | 1.8 |
| Liver Margin (ODO4309) | 0.1 | 1.1 | Thyroid Margin A302153 | 16.0 | 17.6 |
| Colon mets to lung (OD04451-01) | 2.0 | 0.8 | Normal Breast | 16.7 | 13.2 |
| Lung Margin (OD04451-02) | 3.8 | 4.3 | Breast Cancer (OD04566) | 22.5 | 11.2 |
| Normal Prostate 6546-1 | 1.8 | 3.9 | Breast Cancer (OD04590-01) | 9.2 | 8.9 |
| Prostate Cancer (OD04410) | 14.3 | 19.3 | Breast Cancer Mets (OD04590-03) | 26.4 | 20.6 |
| Prostate Margin (OD04410) | 19.9 | 16.7 | Breast Cancer Metastasis (OD04655-05) | 2.9 | 4.6 |
| Prostate Cancer (OD04720-01) | 17.2 | 17.4 | Breast Cancer 064006 | 5.3 | 8.4 |
| Prostate Margin (OD04720-02) | 22.2 | 29.1 | Breast Cancer 1024 | 8.5 | 6.7 |
| Normal Lung 061010 | 35.4 | 43.2 | Breast Cancer 9100266 | 7.9 | 8.7 |
| Lung Met to Muscle (ODO4286) | 14.2 | 13.0 | Breast Margin 9100265 | 7.9 | 5.6 |
| Muscle Margin (ODO4286) | 17.9 | 12.8 | Breast Cancer A209073 | 10.9 | 13.7 |
| Lung Malignant Cancer (OD03126) | 6.6 | 7.5 | Breast Margin A2090734 | 2.5 | 4.1 |
| Lung Margin (OD03126) | 10.3 | 10.2 | Normal Liver | 0.7 | 0.7 |
| Lung Cancer (OD04404) | 2.6 | 3.4 | Liver Cancer 064003 | 0.1 | 0.2 |
| Lung Margin (OD04404) | 12.9 | 12.2 | Liver Cancer 1025 | 0.3 | 0.1 |
| Lung Cancer (OD04565) | 0.9 | 2.0 | Liver Cancer 1026 | 0.2 | 0.1 |
| Lung Margin (OD04565) | 4.0 | 2.1 | Liver Cancer 6004-T | 0.1 | 0.1 |
| Lung Cancer (OD04237-01) | 2.7 | 3.7 | Liver Tissue 6004-N | 0.2 | 0.3 |
| Lung Margin (OD04237-02) | 17.6 | 16.8 | Liver Cancer 6005-T | 0.5 | 0.2 |
| Ocular Mel Met to Liver (ODO4310) | 0.1 | 0.3 | Liver Tissue 6005-N | 0.1 | 0.0 |
| Liver Margin (ODO4310) | 0.2 | 0.0 | Normal Bladder | 10.1 | 17.1 |
| Melanoma Mets to Lung (OD04321) | 7.8 | 7.2 | Bladder Cancer 1023 | 1.8 | 1.3 |
| Lung Margin (OD04321) | 31.0 | 23.5 | Bladder Cancer A302173 | 3.9 | 5.4 |
| Normal Kidney | 41.8 | 58.2 | Bladder Cancer (OD04718-01) | 4.4 | 2.2 |

TABLE 49-continued

Panel 2D

| Tissue Name | Rel. Exp.(%) Ag2847, Run 161930456 | Rel. Exp.(%) Ag2880, Run 159996526 | Tissue Name | Rel. Exp.(%) Ag2847, Run 161930456 | Rel. Exp.(%) Ag2880, Run 159996526 |
|---|---|---|---|---|---|
| Kidney Ca, Nuclear grade 2 (OD04338) | 3.4 | 7.9 | Bladder Normal Adjacent (OD04718-03) | 97.9 | 88.3 |
| Kidney Margin (OD04338) | 22.4 | 14.3 | Normal Ovary | 7.2 | 4.0 |
| Kidney Ca Nuclear grade 1/2 (OD04339) | 0.7 | 3.5 | Ovarian Cancer 064008 | 14.0 | 14.8 |
| Kidney Margin (OD04339) | 17.3 | 15.3 | Ovarian Cancer (OD04768-07) | 0.1 | 0.4 |
| Kidney Ca, Clear cell type (OD04340) | 1.3 | 4.0 | Ovary Margin (OD04768-08) | 6.4 | 7.6 |
| Kidney Margin (OD04340) | 35.4 | 40.1 | Normal Stomach | 40.6 | 46.3 |
| Kidney Ca, Nuclear grade 3 (OD04348) | 0.6 | 0.2 | Gastric Cancer 9060358 | 10.8 | 9.0 |
| Kidney Margin (OD04348) | 10.0 | 11.2 | Stomach Margin 9060359 | 9.8 | 11.3 |
| Kidney Cancer (OD04622-01) | 2.0 | 0.9 | Gastric Cancer 9060395 | 26.6 | 36.1 |
| Kidney Margin (OD04622-03) | 2.4 | 3.1 | Stomach Margin 9060394 | 14.2 | 14.7 |
| Kidney Cancer (OD04450-01) | 0.0 | 2.1 | Gastric Cancer 9060397 | 7.5 | 7.9 |
| Kidney Margin (OD04450-03) | 19.8 | 13.0 | Stomach Margin 9060396 | 5.1 | 3.8 |
| Kidney Cancer 8120607 | 2.0 | 1.5 | Gastric Cancer 064005 | 21.0 | 22.4 |

TABLE 50

Panel 4D

| Tissue Name | Rel. Exp. (%) Ag2847, Run 159841938 | Rel. Exp. (%) Ag2847, Run 159996551 | Tissue Name | Rel. Exp. (%) Ag2847, Run 159841938 | Rel. Exp. (%) Ag2847, Run 159996551 |
|---|---|---|---|---|---|
| Secondary Th1 act | 0.0 | 0.2 | HUVEC IL-1 beta | 3.3 | 16.0 |
| Secondary Th2 act | 0.1 | 0.0 | HUVEC IFN gamma | 3.8 | 17.8 |
| Secondary Tr1 act | 0.0 | 0.0 | HUVEC TNF alpha + IFN gamma | 3.5 | 13.9 |
| Secondary Th1 rest | 0.0 | 0.0 | HUVEC TNF alpha + IL4 | 5.1 | 15.8 |
| Secondary Th2 rest | 0.0 | 0.0 | HUVEC IL-11 | 1.8 | 5.3 |
| Secondary Tr1 rest | 0.0 | 0.0 | Lung Microvascular EC none | 1.8 | 6.6 |
| Primary Th1 act | 0.0 | 0.0 | Lung Microvascular EC TNF alpha + IL-1 beta | 2.1 | 12.1 |
| Primary Th2 act | 0.3 | 0.6 | Microvascular Dermal EC none | 1.6 | 4.6 |
| Primary Tr1 act | 0.0 | 1.2 | Microsvasular Dermal EC TNF alpha + IL-1 beta | 0.7 | 1.3 |
| Primary Th1 rest | 0.0 | 0.6 | Bronchial epithelium TNF alpha + IL1 beta | 0.0 | 2.7 |
| Primary Th2 rest | 100.0 | 0.4 | Small airway epithelium none | 0.1 | 0.7 |
| Primary Tr1 rest | 0.0 | 0.0 | Small airway epithelium TNF alpha + IL-1 beta | 0.0 | 1.6 |
| CD45RA CD4 lymphocyte act | 2.0 | 21.5 | Coronery artery SMC rest | 7.4 | 53.2 |
| CD45RO CD4 lymphocyte act | 0.0 | 0.7 | Coronery artery SMC TNF alpha + IL-1 beta | 6.1 | 27.5 |
| CD8 lymphocyte act | 0.1 | 0.2 | Astrocytes rest | 1.4 | 5.7 |
| Secondary CD8 lymphocyte rest | 0.0 | 0.5 | Astrocytes TNF alpha + IL-1 beta | 0.7 | 5.8 |

TABLE 50-continued

Panel 4D

| Tissue Name | Rel. Exp. (%) Ag2847, Run 159841938 | Rel. Exp. (%) Ag2847, Run 159996551 | Tissue Name | Rel. Exp. (%) Ag2847, Run 159841938 | Rel. Exp. (%) Ag2847, Run 159996551 |
|---|---|---|---|---|---|
| Secondary CD8 lymphocyte act | 0.0 | 0.0 | KU-812 (Basophil) rest | 0.0 | 0.7 |
| CD4 lymphocyte none | 0.0 | 0.0 | KU-812 (Basophil) PMA/ionomycin | 0.0 | 0.5 |
| 2ry Th1/Th2/Tr1_anti-CD95 CH11 | 0.0 | 0.0 | CCD1106 (Keratinocytes) none | 0.0 | 00 |
| LAK cells rest | 0.0 | 0.0 | CCD1106 (Keratinocytes) TNF alpha + IL-1 beta | 0.0 | 0.0 |
| LAK cells IL-2 | 0.0 | 0.3 | Liver cirrhosis | 0.2 | 1.3 |
| LAK cells IL-2 + IL-12 | 0.0 | 0.2 | Lupus kidney | 1.5 | 3.5 |
| LAk cells IL-2 + IFN gamma | 0.0 | 0.2 | NCI-H292 none | 0.5 | 2.4 |
| LAK cells IL-2 + IL-18 | 0.0 | 0.2 | NCI-H292 IL-4 | 1.5 | 7.5 |
| LAK cells PMA/ionomycin | 0.0 | 0.0 | NCI-H292 IL-9 | 1.5 | 9.3 |
| NK Cells IL-2 rest | 0.0 | 0.0 | NCI-H292 IL-13 | 0.9 | 3.5 |
| Two Way MLR 3 day | 0.0 | 0.7 | NCI-H292 IFN gamma | 0.7 | 2.4 |
| Two Way MLR 5 day | 0.0 | 0.4 | HPAEC none | 3.8 | 16.5 |
| Two Way MLR 7 day | 0.0 | 0.1 | HPAEC TNF alpha + IL-1 beta | 2.7 | 17.4 |
| PBMC rest | 0.0 | 0.0 | Lung fibroblast none | 1.2 | 7.3 |
| PBMC PWM | 0.1 | 0.1 | Lung fibroblast TNF alpha + IL-1 beta | 1.1 | 3.2 |
| PBMC PHA-L | 0.1 | 0.0 | Lung fibroblast IL-4 | 2.0 | 14.6 |
| Ramos (B cell) none | 1.7 | 7.0 | Lung fibroblast IL-9 | 3.0 | 15.3 |
| Ramos (B cell) ionomycin | 25.3 | 100.0 | Lung fibroblast IL-13 | 1.2 | 8.4 |
| B lymphocytes PWM | 0.0 | 0.4 | Lung fibroblast IFN gamma | 2.5 | 15.2 |
| B lymphocytes CD40L and IL-4 | 0.0 | 0.8 | Dermal fibroblast CCD1070 rest | 12.6 | 89.5 |
| EOL-1 dbcAMP | 0.0 | 0.0 | Dermal fibroblast CCD1070 TNF alpha | 12.1 | 88.3 |
| EOL-1 dbcAMP PMA/ionomycin | 0.0 | 0.2 | Dermal fibroblast CCD1070 IL-1 beta | 6.3 | 51.4 |
| Dendritic cells none | 0.0 | 0.0 | Dermal fibroblast IFN gamma | 3.5 | 20.7 |
| Dendritic cells LPS | 0.0 | 0.1 | Dermal fibroblast IL-4 | 6.3 | 35.6 |
| Dendritic cells anti-CD40 | 0.0 | 0.6 | IBD Colitis 2 | 0.7 | 5.0 |
| Monocytes rest | 0.4 | 1.7 | IBD Crohn's | 0.9 | 6.1 |
| Monocytes LPS | 0.0 | 0.0 | Colon | 5.0 | 42.0 |
| Macrophages rest | 0.0 | 0.0 | Lung | 2.6 | 16.5 |
| Macrophages LPS | 0.0 | 0.0 | Thymus | 4.7 | 44.4 |
| HUVEC none | 7.2 | 33.7 | Kidney | 3.5 | 19.2 |
| HUVEC starved | 11.3 | 70.7 | | | |

TABLE 51

Panel CNS_1

| Tissue Name | Rel. Exp.(%) Ag2847, Run 171669934 | Rel. Exp.(%) Ag2880, Run 171688447 | Tissue Nme | Rel. Exp.(%) Ag2847, Run 171669934 | Rel. Exp.(%) Ag2880, Run 171688447 |
|---|---|---|---|---|---|
| BA4 Control | 31.2 | 13.0 | BA17 PSP | 34.2 | 8.7 |
| BA4 Control2 | 61.6 | 58.6 | BA17 PSP2 | 9.6 | 2.6 |
| BA4 Alzheimer's2 | 6.1 | 0.7 | Sub Nigra Control | 12.2 | 5.3 |
| BA4 Parkinson's | 36.6 | 15.9 | Sub Nigra Control2 | 19.6 | 19.6 |

TABLE 51-continued

Panel CNS_1

| Tissue Name | Rel. Exp.(%) Ag2847, Run 171669934 | Rel. Exp.(%) Ag2880, Run 171688447 | Tissue Nme | Rel. Exp.(%) Ag2847, Run 171669934 | Rel. Exp.(%) Ag2880, Run 171688447 |
|---|---|---|---|---|---|
| BA4 Parkinson's2 | 68.8 | 60.3 | Sub Nigra Alzheimer's2 | 5.9 | 1.2 |
| BA4 Huntington's | 31.6 | 30.1 | Sub Nigra Parkinson's2 | 24.0 | 17.7 |
| BA4 Huntington's2 | 4.6 | 0.0 | Sub Nigra Huntington's | 31.9 | 14.6 |
| BA4 PSP | 7.7 | 1.1 | Sub Nigra Huntington's2 | 11.2 | 7.3 |
| BA4 PSP2 | 27.7 | 9.7 | Sub Nigra PSP2 | 6.0 | 2.5 |
| BA4 Depression | 14.5 | 6.3 | Sub Nigra Depression | 2.5 | 3.2 |
| BA4 Depression2 | 8.3 | 0.0 | Sub Nigra Depression2 | 3.7 | 1.2 |
| BA7 Control | 53.2 | 23.3 | Glob Palladus Control | 5.1 | 2.6 |
| BA7 Control2 | 33.7 | 25.3 | Glob Palladus Control2 | 6.1 | 2.5 |
| BA7 Alzheimer's2 | 11.6 | 2.3 | Glob Palladus Alzheimer's | 4.5 | 2.1 |
| BA7 Parkinson's | 16.6 | 5.3 | Glob Palladus Alzheimer's2 | 1.7 | 1.1 |
| BA7 Parkinson's2 | 51.4 | 45.1 | Glob Palladus Parkinson's | 36.6 | 25.5 |
| BA7 Huntington's | 42.3 | 22.8 | Glob Palladus Parkinson's2 | 5.3 | 1.2 |
| BA7 Huntington's2 | 50.7 | 14.0 | Glob Palladus PSP | 1.7 | 0.6 |
| BA7 PSP | 43.8 | 21.8 | Glob Palladus PSP2 | 3.9 | 0.0 |
| BA7 PSP2 | 36.3 | 19.5 | Glob Palladus Depression | 2.0 | 0.4 |
| BA7 Depression | 12.7 | 1.2 | Temp Pole Control | 17.1 | 9.3 |
| BA9 Control | 25.0 | 9.7 | Temp Pole Control2 | 69.7 | 57.8 |
| BA9 Control2 | 100.0 | 100.0 | Temp Pole Alzheimer's | 7.9 | 0.3 |
| BA9 Alzheimer's | 8.1 | 1.1 | Temp Pole Alzheimer's2 | 5.3 | 1.3 |
| BA9 Alzheimer's2 | 18.3 | 3.5 | Temp Pole Parkinson's | 30.6 | 13.6 |
| BA9 Parkinson's | 37.1 | 13.5 | Temp Pole Parkinson's2 | 29.3 | 11.3 |
| BA9 Parkinson's | 63.3 | 55.1 | Temp Pole Huntington's | 43.2 | 18.3 |
| BA9 Huntington's2 | 55.1 | 32.3 | Temp Pole PSP | 7.0 | 0.5 |
| BA9 Huntington's2 | 12.2 | 0.9 | Temp Pole PSP2 | 8.6 | 0.5 |
| BA9 PSP | 15.2 | 4.3 | Temp Pole Depression2 | 4.5 | 0.7 |
| BA9 PSP2 | 7.2 | 2.5 | Cing Gyr Control | 73.2 | 40.6 |
| BA9 Depression | 3.5 | 3.1 | Cing Gyr Control2 | 38.2 | 17.4 |
| BA9 Depression2 | 7.9 | 1.6 | Cing Gyr Alzheimer's | 25.5 | 8.8 |
| BA17 Control | 59.0 | 19.6 | Cing Gyr Alzheimer's2 | 9.5 | 1.4 |
| BA17 Control2 | 67.8 | 39.5 | Cing Gyr Parkinson's | 24.3 | 9.3 |
| BA17 Alzheimer's2 | 16.8 | 1.8 | Cing Gyr Parkinson's2 | 34.4 | 32.8 |
| BA17 Parkinson's | 37.4 | 9.1 | Cing Gyr Huntington's | 63.7 | 38.4 |
| BA17 Parkinson's2 | 56.6 | 36.6 | Cing Gyr Huntington's2 | 12.5 | 4.6 |
| BA17 Huntington's | 37.1 | 16.3 | Cing Gyr PSP | 15.5 | 7.5 |
| BA17 Huntington's2 | 15.9 | 5.1 | Cing Gyr PSP2 | 5.8 | 0.0 |
| BA17 Depression | 6.1 | 0.0 | Cing Gyr Depression | 22.9 | 0.0 |

TABLE 51-continued

| | Panel CNS_1 | | | | |
|---|---|---|---|---|---|
| Tissue Name | Rel. Exp.(%) Ag2847, Run 171669934 | Rel. Exp.(%) Ag2880, Run 171688447 | Tissue Nme | Rel. Exp.(%) Ag2847, Run 171669934 | Rel. Exp.(%) Ag2880, Run 171688447 |
| BA17 Depression2 | 28.1 | 7.1 | Cing Gyr Depression2 | 9.2 | 1.8 |

CNS_neurodegeneration_v1.0 Summary: Ag2847/2880 The results from this experiment confirm the expression of this gene at moderate level in the CNS in an independent group of patients. However, no clear relationship between the expression levels of the CG56087-01gene and Alzheimer's disease is evident. Please see Panel 1.3D for discussion of utility of this gene in the central nervous system.

Panel 1.3D Summary: Ag2847/2880 Two experiments with two different probe and primer sets show highest expression of the CG56087-01 gene, a kilon homolog, in the brain. This gene is expressed at high to moderate levels throughout the central nervous system, including in amygdala, cerebellum, hippocampus, substantia nigra, thalamus, cerebral cortex and spinal cord. This expression profile is consistent with published reports of kilon expression. The sequence of kilon shows a high degree of homology to that of the chicken protein neurotractin, a molecule involved in neurite outgrowth capable of interacting with LAMP. Because this class of molecules is thought to play a role in the guidance of growing axons and kilon is expressed specifically in neurons, it has been suggested that they confer the ability to rearrange dendritic connectivity on magnocellular neurons. Degeneration of dendritic orphology and connectivity is a pathological characteristic of neurodegenerative diseases, such as Alzheimer's disease. Recombinant neurotractin promotes neurite outgrowth of telencephalic neurons and interacts with the IgSF members CEPU-1. Therefore, the CG56087-01gene product may be used as a protein therapeutic to counter neurodegeneration in a variety of neurodegenerative diseases.

In contrast, expression of the CG56087-01 gene is relatively low in brain cancer derived cell lines when compared to its levels in the normal brain. Thus, expression of this gene could be used to distinguish brain-derived tissue from other tissues in the panel. Moreover, therapeutic modulation of this gene or its protein product, through the use of small molecule drugs, antibodies or protein therapeutics, might be of use in the treatment of brain cancer.

This gene is also moderately expressed in a variety of metabolic and tissues including pancreas, adrenal gland, thyroid, pituitary gland, adult and fetal heart, and adipose. Thus, this gene may be an antibody target for the treatment of diseases in these tissues including Types 1 and 2 diabetes, cardiovascular disease and obesity (Marg A, Sirim P, Spaltmann F, Plagge A, Kauselmann G, Buck F, Rathjen F G, Brummendorf T. Neurotractin, a novel neurite outgrowth-promoting Ig-like protein that interacts with CEPU-1 and LAMP. J Cell Biol 1999 May 17;145(4):865–76; Funatsu N, Miyata S, Kumanogoh H, Shigeta M, Hamada K, Endo Y, Sokawa Y, Maekawa S. Characterization of a novel rat brain glycosylphosphatidylinositol-anchored protein (Kilon), a member of the IgLON cell adhesion molecule family. J Biol Chem 1999 Mar. 19;274(12):8224–30; Brauer A U, Savaskan N E, Plaschke M, Prehn S, Ninnemann O, Nitsch R. IG-molecule Kilon shows differential expression pattern from LAMP in the developing and adult rat hippocampus. Hippocampus 2000; 10(6):632–44; Lodge A P, Howard M R, McNamee C J, Moss D J. Co-localisation, heterophilic interactions and regulated expression of IgLON family proteins in the chick nervous system. Brain Res Mol Brain Res 2000 Oct. 20;82(1–2):84–94; Miyata S, Funatsu N, Matsunaga W, Kiyohara T, Sokawa Y, Maekawa S. Expression of the IgLON cell adhesion molecules Kilon and OBCAM in hypothalamic magnocellular neurons. J Comp Neurol 2000 Aug. 14;424(1):74–85).

Panel 2D Summary: Ag2847/2880 Two experiments with different probe and primer sets produced results that are in very good agreement, with highest expression of the CG56087-01 gene in a sample derived from normal colon tissue (CTs=27–29). In addition, there is substantial expression of this gene in samples derived from normal colon tissue when compared to their adjacent malignant counterparts. The trend toward differential expression in normal tissues over their malignant counterparts is also seen in kidney samples and bladder samples. Thus, the expression of this gene could be used to distinguish normal colon, bladder or kidney from their malignant counterparts. Moreover, therapeutic modulation of this gene or its protein product, through the use of small molecule drugs, antibodies or protein therapeutics, might be of use in the treatment of colon, bladder or kidney cancer.

Panel 4D Summary: Ag2880 The CG56087-01 transcript is expressed in endothelial cells, fibroblasts, activated Ramos B cells and activated CD45RA (naive) T cells but not in primary B cells. This gene encodes a putative adhesion molecule that has been hypothesized to be involved in the establishment and remodeling of neural circuits. The role of this protein in the immune system has not been examined, however, based on its CNS function it may be involved in cell-cell binding that leads to leukocyte interactions with endothelium resulting in leukocyte extravasastion. Alternatively, the protein encoded for by this transcript may be important in other cellular interactions. Therefore, therapeutics designed with the protein encoded for by this transcript could be important in the treatment of inflammation resulting from asthma, chronic obstructive pulmonary disease, inflammatory bowel disease, arthritis, and psoriasis. Please note that data from a second experiment using the probe and primer set Ag2847 are not included because the amp plot suggests that there were experimental difficulties with this run.

Panel CNS_1 Summary: Ag2847/2880 Two experiments with different probe and primer sets produce results that are in very good agreement, confirming expression of the CG56087-01 gene in the brain. Please see Panel 1.3D for discussion of utility of this gene in the central nervous system.

G. NOV7: Mixed Lineage Kinase 2-like

Expression of the NOV7 gene (CG56071-01) was assessed using the primer-probe sets Ag2872 and Ag4847, described in Tables 52–53. Results of the RTQ-PCR runs are shown in Tables 54–63.

TABLE 52

Probe Name Ag2872

| Primers | Sequences | | Length | Start Position |
|---|---|---|---|---|
| Forward | 5'-tcagccagaccatagagaatgt-3' | (SEQ ID NO:220) | 22 | 506 |
| Probe | TET-5'-atgctgaagcaccccaacatcattg-3'-TAMRA | (SEQ ID NO:221) | 25 | 553 |
| Reverse | 5'-ctccttcagacatacccctctt-3' | (SEQ ID NO:222) | 22 | 582 |

TABLE 53

Probe Name Ag4847

| Primers | Sequences | | Length | Start Position |
|---|---|---|---|---|
| Forward | 5'-catagagaatggtcgccaagag-3' | (SEQ ID NO:223) | 22 | 516 |
| Probe | TET-5'-atgctgaagcaccccaacatcattg-3'-TAMRA | (SEQ ID NO:224) | 25 | 553 |
| Reverse | 5'-ctccttcagacatacccctctt-3' | (SEQ ID NO:225) | 22 | 582 |

TABLE 54

CNS_neurodegeneration_v1.0

| Tissue Name | Rel. Exp.(%) Ag2872, Run 209779299 | Tissue Name | Rel. Exp.(%) Ag2872, Run 209779299 |
|---|---|---|---|
| AD 1 Hippo | 7.4 | Control (Path) 3 Temporal Ctx | 1.3 |
| AD 2 Hippo | 16.5 | Control (Path) 4 Temporal Ctx | 24.5 |
| AD 3 Hippo | 5.3 | AD 1 Occipital Ctx | 15.8 |
| AD 4 Hippo | 5.3 | AD 2 Occipital Ctx (Missing) | 0.0 |
| AD 5 Hippo | 100.0 | AD 3 Occipital Ctx | 3.3 |
| AD 6 Hippo | 29.7 | AD 4 Occipital Ctx | 20.7 |
| Control 2 Hippo | 31.9 | AD 5 Occipital Ctx | 52.5 |
| Control 4 Hippo | 4.6 | AD 6 Occipital Ctx | 31.2 |
| Control (Path) 3 Hippo | 2.9 | Control 1 Occipital Ctx | 0.9 |
| AD 1 Temporal Ctx | 9.5 | Control 2 Occipital Ctx | 79.6 |
| AD 2 Temporal Ctx | 17.2 | Control 3 Occipital Ctx | 17.8 |
| AD 3 Temporal Ctx | 4.5 | Control 4 Occipital Ctx | 2.1 |
| AD 4 Temporal Ctx | 15.0 | Control (Path) 1 Occipital Ctx | 71.2 |
| AD 5 Inf Temporal Ctx | 81.2 | Control (Path) 2 Occipital Ctx | 10.2 |
| AD 5 Sup Temporal Ctx | 20.9 | Control (Path) 3 Occipital Ctx | 0.6 |
| AD 6 Inf Temporal Ctx | 24.7 | Control (Path) 4 Occipital Ctx | 16.6 |
| AD 6 Sup Temporal Ctx | 32.8 | Control 1 Parietal Ctx | 2.6 |
| Control 1 Temporal Ctx | 3.0 | Control 2 Parietal Ctx | 24.7 |
| Control 2 Temporal Ctx | 40.9 | Control 3 Parietal Ctx | 17.0 |
| Control 3 Temporal Ctx | 14.9 | Control (Path) 1 Parietal Ctx | 76.3 |
| Control 3 Temporal Ctx | 4.9 | Control (Path) 2 Parietal Ctx | 20.2 |
| Control (Path) 1 Temporal Ctx | 63.7 | Control (Path) 3 Parietal Ctx | 2.2 |
| Control (Path) 2 Temporal Ctx | 35.4 | Control (Path) 4 Parietal Ctx | 33.4 |

TABLE 55

| General_screening_panel_v1.5 | | | |
|---|---|---|---|
| Tissue Name | Rel. Exp. (%) Ag4847, Run 228796410 | Tissue Name | Rel. Exp. (%) Ag4847, Run 228796410 |
| Adipose | 1.0 | Renal ca. TK-10 | 13.9 |
| Melanoma* Hs688(A).T | 0.1 | Bladder | 5.8 |
| Melanoma* Hs688(B).T | 0.0 | Gastric ca. (liver met.) NCI-N87 | 21.5 |
| Melanoma* M14 | 5.4 | Gastric ca. KATO III | 14.7 |
| Melanoma* LOXIMVI | 1.6 | Colon ca. SW-948 | 4.3 |
| Melanoma* SK-MEL-5 | 9.2 | Colon ca. SW480 | 16.2 |
| Squamous cell carcinoma SCC-4 | 28.9 | Colon ca.* (SW480 met) SW620 | 5.4 |
| Testis Pool | 2.8 | Colon ca. HT29 | 4.8 |
| Prostate ca.* (bone met) PC-3 | 7.2 | Colon ca. HCT-116 | 13.4 |
| Prostate Pool | 1.5 | Colon ca. CaCo-2 | 13.6 |
| Placenta | 5.3 | Colon cancer tissue | 3.0 |
| Uterus Pool | 1.0 | Colon ca. SW1116 | 2.3 |
| Ovarian ca. OVCAR-3 | 10.1 | Colon ca. Colo-205 | 2.7 |
| Ovarian ca. SK-OV-3 | 23.5 | Colon ca. SW-48 | 2.1 |
| Ovarian ca. OVCAR-4 | 7.1 | Colon Pool | 0.6 |
| Ovarian ca. OVCAR-5 | 24.0 | Small Intestine Pool | 1.3 |
| Ovarian ca. IGROV-1 | 29.5 | Stomach Pool | 1.3 |
| Ovarian ca. OVCAR-8 | 3.7 | Bone Marrow Pool | 0.9 |
| Ovary | 1.0 | Fetal Heart | 0.9 |
| Breast ca. MCF-7 | 10.5 | Heart Pool | 0.3 |
| Breast ca. MDA-MB-231 | 10.9 | Lymph Node Pool | 0.9 |
| Breast ca. BT 549 | 0.4 | Fetal Skeletal Muscle | 0.1 |
| Breast ca. T47D | 11.7 | Skeletal Muscle Pool | 2.9 |
| Breast ca. MDA-N | 1.6 | Spleen Pool | 2.4 |
| Breast Pool | 1.1 | Thymus Pool | 2.5 |
| Trachea | 3.9 | CNS cancer (glio/astro) U87-MG | 13.3 |
| Lung | 0.3 | CNS cancer (glio/astro) U-118-MG | 0.5 |
| Fetal Lung | 4.2 | CNS cancer (neuro;met) SK-N-AS | 3.7 |
| Lung ca. NCI-N417 | 2.1 | CNS cancer (astro) SF-539 | 0.8 |
| Lung ca. LX-1 | 8.8 | CNS cancer (astro) SNB-75 | 0.2 |
| Lung ca. NCI-H146 | 5.6 | CNS cancer (glio) SNB-19 | 4.0 |
| Lung ca. SHP-77 | 13.1 | CNS cancer (glio) SF-295 | 2.8 |
| Lung ca. A549 | 13.4 | Brain (Amygdala) Pool | 8.2 |
| Lung ca. NCI-H526 | 4.0 | Brain (cerebellum) | 100.0 |
| Lung ca. NCI-H23 | 7.3 | Brain (fetal) | 15.9 |
| Lung ca. NCI-H460 | 1.1 | Brain (Hippocampus) Pool | 8.1 |
| Lung ca. HOP-62 | 4.7 | Cerebral Cortex Pool | 18.3 |
| Lung ca. NCI-H522 | 7.1 | Brain (Substantia nigra) Pool | 24.0 |
| Liver | 0.4 | Brain (Thalamus) Pool | 13.7 |
| Fetal Liver | 1.2 | Brain (whole) | 18.8 |
| Liver ca. HepG2 | 6.0 | Spinal Cord Pool | 3.5 |
| Kidney Pool | 0.5 | Adrenal Gland | 2.6 |
| Fetal Kidney | 2.6 | Pituitary gland Pool | 2.3 |
| Renal ca. 786-0 | 10.8 | Salivary Gland | 1.8 |
| Renal ca. A498 | 9.5 | Thyroid (female) | 1.0 |
| Renal ca. ACHN | 11.0 | Pancreatic ca. CAPAN2 | 19.2 |
| Renal ca. UO-31 | 15.9 | Pancreas Pool | 2.5 |

TABLE 56

| Panel 1.3D | | | | | | | |
|---|---|---|---|---|---|---|---|
| Tissue Name | Rel. Exp.(%) Ag2872, Run 161971644 | Rel. Exp.(%) Ag2872, Run 165721686 | Rel. Exp.(%) Ag2872, Run 166006455 | Tissue Name | Rel. Exp.(%) Ag2872, Run 161971644 | Rel. Exp.(%) Ag2872, Run 165721686 | Rel. Exp.(%) Ag2872, Run 166006455 |
| Liver adenocarcinoma | 16.7 | 22.5 | 21.8 | Kidney (fetal) | 1.9 | 2.9 | 1.1 |
| Pancreas | 0.3 | 4.3 | 5.4 | Renal ca. 786-0 | 2.8 | 17.6 | 15.0 |

TABLE 56-continued

Panel 1.3D

| Tissue Name | Rel. Exp.(%) Ag2872, Run 161971644 | Rel. Exp.(%) Ag2872, Run 165721686 | Rel. Exp.(%) Ag2872, Run 166006455 | Tissue Name | Rel. Exp.(%) Ag2872, Run 161971644 | Rel. Exp.(%) Ag2872, Run 165721686 | Rel. Exp.(%) Ag2872, Run 166006455 |
|---|---|---|---|---|---|---|---|
| Pancreatic ca. CAPAN 2 | 5.5 | 45.4 | 44.8 | Renal ca. A498 | 4.5 | 36.1 | 12.7 |
| Adrenal gland | 0.5 | 2.2 | 0.3 | Renal ca. RXF 393 | 13.5 | 85.9 | 77.9 |
| Thyroid | 0.9 | 1.7 | 1.6 | Renal ca. ACHN | 6.4 | 17.8 | 17.8 |
| Salivary gland | 0.5 | 3.7 | 5.4 | Renal ca. UO-31 | 5.0 | 27.0 | 19.3 |
| Pituitary gland | 1.7 | 11.4 | 4.3 | Renal ca. TK-10 | 2.3 | 7.9 | 10.0 |
| Brain (fetal) | 2.9 | 24.5 | 22.1 | Liver | 0.2 | 0.0 | 1.0 |
| Brain (whole) | 6.1 | 66.4 | 79.6 | Liver (fetal) | 0.4 | 0.8 | 0.7 |
| Brain (amygdala) | 6.4 | 49.7 | 41.8 | Liver ca. (hepatoblast) HepG2 | 4.3 | 14.7 | 18.6 |
| Brain (cerebellum) | 13.1 | 82.9 | 100.0 | Lung | 0.5 | 6.0 | 9.0 |
| Brain (hippocampus) | 10.2 | 32.8 | 29.3 | Lung (fetal) | 0.5 | 4.3 | 0.7 |
| Brain (substantia) nigra) | 2.0 | 14.5 | 12.2 | Lung ca. (small cell) LX-1 | 3.4 | 16.0 | 11.6 |
| Brain (thalamus) | 7.4 | 42.6 | 63.3 | Lung ca. (small cell) NCI-H69 | 3.6 | 26.1 | 26.4 |
| Cerebral Cortex | 100.0 | 84.1 | 90.1 | Lung Ca. (s.cell var.) SHP-77 | 11.1 | 25.0 | 13.8 |
| Spinal cord | 0.9 | 3.1 | 3.6 | Lung ca. (large cell) NCI-H460 | 0.3 | 4.3 | 43.2 |
| glio/astro U87-MG | 13.2 | 14.5 | 15.7 | Lung ca. (non-sm. cell) A549 | 3.9 | 8.0 | 9.9 |
| glio/astro U-118-MG | 0.0 | 0.0 | 0.0 | Lung ca. (non-s.cell) NCI-H23 | 3.0 | 6.8 | 3.6 |
| astrocytoma SW1783 | 7.3 | 7.9 | 10.3 | Lung ca. (non-s.cell) HOP-62 | 2.0 | 8.7 | 6.4 |
| neuro*; met SK N-AS | 1.2 | 5.9 | 2.2 | Lung ca. (non-s.cl) NCI-H522 | 2.6 | 5.0 | 3.1 |
| astrocytoma SF-539 | 1.0 | 3.7 | 6.0 | Lung ca. (squam.) SW 900 | 15.6 | 58.2 | 94.0 |
| astrocytoma SNB-75 | 9.7 | 100.0 | 21.3 | Lung ca. (squam.) NCI-H596 | 2.5 | 16.5 | 19.3 |
| glioma SNB-19 | 2.5 | 6.4 | 6.7 | Mammary gland | 0.7 | 6.2 | 2.0 |
| glioma U251 | 2.8 | 22.2 | 8.9 | Breast ca.* (pl.ef) MCF-7 | 11.3 | 21.9 | 16.7 |
| glioma SF-295 | 1.2 | 3.7 | 6.3 | Breast ca.* (pl.ef) MDA-MB-231 | 4.1 | 32.3 | 6.7 |
| Heart (fetal) | 0.5 | 0.6 | 1.7 | Breast ca.* (pl.ef) T47D | 3.5 | 17.0 | 14.4 |
| Heart | 0.1 | 1.1 | 0.0 | Breast ca. BT-549 | 0.3 | 4.7 | 0.8 |
| Skeletal muscle (fetal) | 0.8 | 0.7 | 0.3 | Breast ca. MDA-N | 1.0 | 0.9 | 3.3 |
| Skeletal muscle | 1.0 | 4.4 | 2.5 | Ovary | 2.3 | 1.4 | 0.0 |
| Bone marrow | 0.4 | 1.4 | 0.9 | Ovarian ca. OVCAR-3 | 3.9 | 19.1 | 10.2 |
| Thymus | 2.5 | 0.7 | 2.3 | Ovarian ca. OVCAR-4 | 1.6 | 25.2 | 22.1 |
| Spleen | 0.7 | 6.0 | 3.3 | Ovarian ca. OVCAR-5 | 6.3 | 27.7 | 40.6 |
| Lymph node | 1.4 | 8.7 | 3.2 | Ovarian ca. OVCAR-8 | 3.3 | 14.0 | 6.2 |

TABLE 56-continued

Panel 1.3D

| Tissue Name | Rel. Exp.(%) Ag2872, Run 161971644 | Rel. Exp.(%) Ag2872, Run 165721686 | Rel. Exp.(%) Ag2872, Run 166006455 | Tissue Name | Rel. Exp.(%) Ag2872, Run 161971644 | Rel. Exp.(%) Ag2872, Run 165721686 | Rel. Exp.(%) Ag2872, Run 166006455 |
|---|---|---|---|---|---|---|---|
| Colorectal | 7.5 | 6.7 | 6.8 | Ovarian ca. IGROV-1 | 1.4 | 4.6 | 11.2 |
| Stomach | 0.9 | 8.3 | 2.8 | Ovarian ca.* (ascites) SK-OV-3 | 6.4 | 46.7 | 39.2 |
| Small intestine | 0.8 | 3.2 | 2.1 | Uterus | 0.1 | 1.1 | 0.0 |
| Colon ca. SW480 | 2.5 | 6.4 | 18.9 | Placenta | 2.2 | 6.8 | 9.7 |
| Colon ca.* SW620(SW480 met) | 3.1 | 13.8 | 9.9 | Prostate | 0.5 | 2.6 | 2.8 |
| Colon ca. HT29 | 3.2 | 3.1 | 4.2 | Prostate ca.* (bone met)PC-3 | 4.4 | 39.2 | 16.6 |
| Colon ca. HCT-116 | 2.9 | 15.0 | 4.8 | Testis | 2.9 | 7.3 | 3.7 |
| Colon ca. CaCo-2 | 9.0 | 11.7 | 9.9 | Melanoma Hs688(A).T | 0.1 | 0.0 | 0.0 |
| Colon ca. tissue(ODO3866) | 4.0 | 6.9 | 4.8 | Melanoma* (met) Hs688(B).T | 0.0 | 0.0 | 0.0 |
| Colon ca. HCC-2998 | 3.1 | 12.6 | 11.1 | Melanoma UACC-62 | 1.6 | 6.3 | 9.3 |
| Gastric ca.* (liver met) NCI-N87 | 11.7 | 54.3 | 23.2 | Melanoma M14 | 0.9 | 11.9 | 2.1 |
| Bladder | 7.3 | 14.7 | 6.6 | Melanoma LOX IMVI | 0.4 | 0.0 | 0.4 |
| Trachea | 2.8 | 5.9 | 2.0 | Melanoma* (met) SK-MEL-5 | 2.1 | 8.4 | 6.0 |
| Kidney | 2.0 | 5.8 | 0.4 | Adipose | 0.7 | 2.4 | 2.4 |

TABLE 57

Panel 2.2

| Tissue Name | Rel. Exp.(%) Ag2872, Run 175149214 | Tissue Name | Rel. Exp.(%) Ag2872, Run 175149214 |
|---|---|---|---|
| Normal Colon | 17.4 | Kidney Margin (OD04348) | 100.0 |
| Colon cancer (OD06064) | 26.6 | Kidney malignant cancer (OD06204B) | 14.1 |
| Colon Margin (OD06064) | 16.2 | Kidney normal adjacent tissue (OD06204E) | 8.5 |
| Colon cancer (OD06159) | 4.4 | Kidney Cancer (OD04450-01) | 29.1 |
| Colon Margin (OD06159) | 11.5 | Kidney Margin (OD04450-03) | 21.3 |
| Colon cancer (OD06297-04) | 1.1 | Kidney Cancer 8120613 | 2.3 |
| Colon Margin (OD06297-015) | 19.6 | Kidney Margin 8120614 | 16.7 |
| CC Gr.2 ascend colon (ODO3921) | 4.4 | Kidney Cancer 9010320 | 0.0 |
| CC Margin (ODO3921) | 3.5 | Kidney Margin 9010321 | 10.4 |
| Colon cancer metastasis (OD06104) | 0.0 | Kidney Cancer 8120607 | 16.3 |
| Lung Margin (OD06104) | 6.6 | Kidney Margin 8120608 | 7.5 |
| Colon mets to lung (OD04451-01) | 33.0 | Normal Uterus | 0.0 |
| Lung Margin (OD04451-02) | 10.8 | Uterine Cancer 064011 | 2.2 |
| Normal Prostate | 7.3 | Normal Thyroid | 0.0 |
| Prostate Cancer (OD04410) | 8.0 | Thyroid Cancer 064010 | 5.8 |
| Prostate Margin (OD04410) | 5.8 | Thyroid Cancer A302152 | 20.0 |
| Normal Ovary | 2.4 | Thyroid Margin A302153 | 3.4 |
| Ovarian cancer (OD06283-03) | 4.2 | Normal Breast | 21.6 |

TABLE 57-continued

| Panel 2.2 | | | |
|---|---|---|---|
| Tissue Name | Rel. Exp.(%) Ag2872, Run 175149214 | Tissue Name | Rel. Exp.(%) Ag2872, Run 175149214 |
| Ovarian Margin (OD06283-07) | 8.2 | Breast Cancer (OD04566) | 8.3 |
| Ovarian Cancer 064008 | 12.2 | Breast Cancer 1024 | 22.5 |
| Ovarian cancer (OD06145) | 4.3 | Breast Cancer (OD04590-01) | 41.2 |
| Ovarian Margin (OD06145) | 8.7 | Breast Cancer Mets (OD04590-03) | 26.1 |
| Ovarian cancer (OD06455-03) | 20.2 | Breast Cancer Metastasis (OD04655-05) | 46.0 |
| Ovarian Margin (OD06455-07) | 0.0 | Breast Cancer 064006 | 15.8 |
| Normal Lung | 7.6 | Breast Cancer 9100266 | 9.6 |
| Invasive poor diff. lung adeno (ODO4945-01) | 27.5 | Breast Margin 9100265 | 1.7 |
| Lung Margin (ODO4945-03) | 14.1 | Breast Cancer A209073 | 9.9 |
| Lung Malignant Cancer (OD03126) | 16.0 | Breast Margin A2090734 | 17.2 |
| Lung Margin (OD03126) | 4.3 | Breast cancer (OD06083) | 50.3 |
| Lung Cancer (OD05014A) | 7.5 | Breast cancer node metastasis (OD06083) | 42.0 |
| Lung Margin (OD05014B) | 16.2 | Normal Liver | 12.2 |
| Lung cancer (OD06081) | 23.8 | Liver Cancer 1026 | 3.2 |
| Lung Margin (OD06081) | 12.3 | Liver Cancer 1025 | 10.4 |
| Lung Cancer (OD04237-01) | 9.9 | Liver Cancer 6004-T | 0.3 |
| Lung Margin (OD04237-02) | 25.5 | Liver Tissue 6004-N | 6.8 |
| Ocular Melanoma Metastasis | 4.3 | Liver Cancer 6005-T | 13.6 |
| Ocular Melanoma Margin (Liver) | 3.7 | Liver Tissue 6005-N | 8.8 |
| Melanoma Metastasis | 5.8 | Liver Cancer 064003 | 21.2 |
| Melanoma Margin (Lung) | 15.1 | Normal Bladder | 17.4 |
| Normal Kidney | 1.8 | Bladder Cancer 1023 | 4.6 |
| Kidney Ca, Nuclear grade 2 (OD04338) | 41.8 | Bladder Cancer A302173 | 22.4 |
| Kidney Margin (OD04338) | 10.4 | Normal Stomach | 27.7 |
| Kidney Ca Nuclear grade 1/2 (OD04339) | 52.1 | Gastric Cancer 9060397 | 3.6 |
| Kidney Margin (OD04339) | 15.3 | Stomach Margin 9060396 | 14.2 |
| Kidney Ca, Clear cell type (OD04340) | 0.0 | Gastric Cancer 9060395 | 5.1 |
| Kidney Margin (OD04340) | 16.8 | Stomach Margin 9060394 | 10.2 |
| Kidney Ca, Nuclear grade 3 (OD04348) | 0.0 | Gastric Cancer 064005 | 12.1 |

TABLE 58

| Panel 2D | | | |
|---|---|---|---|
| Tissue Name | Rel. Exp.(%) Ag2872, Run 161971795 | Tissue Name | Rel. Exp.(%) Ag2872, Run 161971795 |
| Normal Colon | 30.8 | Kidney Margin 8120608 | 2.9 |
| CC Well to Mod Diff (ODO3866) | 13.0 | Kidney Cancer 8120613 | 7.6 |
| CC Margin (ODO3866) | 5.9 | Kidney Margin 8120614 | 15.3 |
| CC Gr.2 rectosigmoid (ODO3868) | 16.2 | Kidney Cancer 9010320 | 10.9 |
| CC Margin (ODO3868) | 3.4 | Kidney Margin 9010321 | 23.0 |
| CC Mod Diff (ODO3920) | 16.3 | Normal Uterus | 0.0 |
| CC Margin (ODO3920) | 10.9 | Uterus Cancer 064011 | 23.5 |
| CC Gr.2 ascend colon (ODO3921) | 20.4 | Normal Thyroid | 4.0 |
| CC Margin (ODO3921) | 4.8 | Thyroid Cancer 064010 | 14.5 |
| CC from Partial Hepatectomy (ODO4309) Mets | 21.6 | Thyroid Cancer A302152 | 15.0 |
| Liver Margin (ODO4309) | 6.2 | Thyroid Margin A302153 | 11.7 |
| Colon mets to lung (OD04451-01) | 24.0 | Normal Breast | 21.3 |
| Lung Margin (OD04451-02) | 9.5 | Breast Cancer (OD04566) | 25.9 |

TABLE 58-continued

Panel 2D

| Tissue Name | Rel. Exp.(%) Ag2872, Run 161971795 | Tissue Name | Rel. Exp.(%) Ag2872, Run 161971795 |
|---|---|---|---|
| Normal Prostate 6546-1 | 1.8 | Breast Cancer (OD04590-01) | 42.3 |
| Prostate Cancer (OD04410) | 19.1 | Breast Cancer Mets OD04590-03) | 39.2 |
| Prostate Margin (OD04410) | 15.2 | Breast Cancer Metastasis (OD04655-05) | 40.9 |
| Prostate Cancer (OD04720-01) | 17.2 | Breast Cancer 064006 | 15.9 |
| Prostate Margin (OD04720-02) | 18.3 | Breast Cancer 1024 | 24.8 |
| Normal Lung 061010 | 31.0 | Breast Cancer 9100266 | 23.8 |
| Lung Met to Muscle (ODO4286) | 12.1 | Breast Margin 9100265 | 7.9 |
| Muscle Margin (ODO4286) | 4.6 | Breast Cancer A209073 | 23.2 |
| Lung Malignant Cancer (OD03126) | 35.4 | Breat Margin A2090734 | 17.2 |
| Lung Margin (OD03126) | 24.8 | Normal Liver | 4.2 |
| Lung Cancer (OD04404) | 43.2 | Liver Cancer 064003 | 10.1 |
| Lung Margin (OD04404) | 14.2 | Liver Cancer 1025 | 3.3 |
| Lung Cancer (OD04565) | 26.6 | Liver Cancer 1026 | 5.3 |
| Lung Margin (OD04565) | 8.1 | Liver Cancer 6004-T | 4.6 |
| Lung Cancer (OD04237-01) | 25.2 | Liver Tissue 6004-N | 8.5 |
| Lung Margin (OD04237-02) | 16.6 | Liver Cancer 6005-T | 5.6 |
| Ocular Mel Met to Liver (ODO4310) | 7.0 | Liver Tissue 6005-N | 1.6 |
| Liver Margin (ODO4310) | 9.2 | Normal Bladder | 28.7 |
| Melanoma Mets to Lung (OD04321) | 8.0 | Bladder Cancer 1023 | 15.1 |
| Lung Margin (OD04321) | 32.1 | Bladder Cancer A302173 | 27.4 |
| Normal Kidney | 32.5 | Bladder Cancer (OD04718-01) | 32.1 |
| Kidney Ca, Nuclear grade 2 (OD04338) | 30.8 | Bladder Normal Adjacent (OD04718-03) | 0.9 |
| Kidney Margin (OD04338) | 32.8 | Normal Ovary | 2.9 |
| Kidney Ca Nuclear grade 1/2 (OD04339) | 31.6 | Ovarian Cancer 064008 | 17.1 |
| Kidney Margin (OD04339) | 23.3 | Ovarian Cancer (OD04768-07) | 100.0 |
| Kidney Ca, Clear cell type (OD04340) | 5.5 | Ovary Margin (OD04768-08) | 1.5 |
| Kidney Margin (OD04340) | 29.5 | Normal Stomach | 15.8 |
| Kidney Ca, Nuclear grade 3 (OD04348) | 0.5 | Gastric Cancer 9060358 | 2.5 |
| Kidney Margin (OD04348) | 27.9 | Stomach Margin 9060359 | 7.5 |
| Kidney Cancer (OD04622-01) | 6.0 | Gastric Cancer 9060395 | 8.8 |
| Kidney Margin (OD04622-03) | 4.5 | Stomach Margin 9060394 | 14.4 |
| Kidney Cancer (OD04450-01) | 16.5 | Gastric Cancer 9060397 | 33.0 |
| Kidney Margin (OD04450-03) | 19.2 | Stomach Margin 9060396 | 7.9 |
| Kidney Cancer 8120607 | 11.5 | Gastric Cancer 064005 | 23.0 |

TABLE 59

Panel 3D

| Tissue Name | Rel. Exp.(%) Ag2872, Run 164543502 | Rel. Exp.(%) Ag2872, Run 164828587 | Tissue Name | Rel. Exp.(%) Ag2872, Run 164543502 | Rel. Exp.(%) Ag2872, Run 164828587 |
|---|---|---|---|---|---|
| Daoy-Medulloblastoma | 2.5 | 1.9 | Ca Ski- Cervical epidermoid carcinoma (metastasis) | 8.2 | 9.7 |
| TE671-Medulloblastoma | 1.5 | 2.0 | ES-2- Ovarian clear cell carcinoma | 0.6 | 0.5 |
| D283 Med-Medulloblastoma | 6.3 | 8.8 | Ramos- Stimulated with PMA/ionomycin 6h | 3.0 | 3.3 |
| PFSK-1- Primitive Neuroectodermal | 1.3 | 1.6 | Ramos- Stimulated with PMA/ionomycin 14h | 3.0 | 3.8 |
| XF-498- CNS | 0.3 | 0.4 | MEG-01- Chronic myelogenous leukemia (megokaryoblast) | 0.4 | 0.8 |

TABLE 59-continued

| Panel 3D | | | | | |
|---|---|---|---|---|---|
| Tissue Name | Rel. Exp.(%) Ag2872, Run 164543502 | Rel. Exp.(%) Ag2872, Run 164828587 | Tissue Name | Rel. Exp.(%) Ag2872, Run 164543502 | Rel. Exp.(%) Ag2872, Run 164828587 |
| SNB-78- Glioma | 0.0 | 0.0 | Raji- Burkitt's lymphoma | 1.2 | 1.1 |
| SF-268- Glioblastoma | 0.7 | 0.9 | Daudi- Burkitt's lymphoma | 2.2 | 2.4 |
| T98G- Glioblastoma | 0.7 | 1.2 | U266- B-cell plasmacytoma | 1.5 | 1.1 |
| SK-N-SH- Neuroblastoma (metastasis) | 1.2 | 2.0 | CA46- Burkitt's lymphoma | 1.4 | 0.8 |
| SF-295- Glioblastoma | 0.4 | 0.6 | RL- non-Hodgkin's B-cell lymphoma | 0.7 | 0.9 |
| Cerebellum | 7.0 | 10.4 | JM1- pre-B-cell lymphoma | 1.2 | 1.7 |
| Cerebellum | 7.9 | 12.1 | Jurkat-T cell leukemia | 1.7 | 1.8 |
| NCI-H292- Mucoepidermoid lung carcinoma | 20.9 | 25.5 | TF-1- Erythroleukemia | 0.2 | 0.2 |
| DMS-114- Small cell lung cancer | 1.6 | 1.7 | HUT 78- T-cell lymphoma | 0.9 | 1.6 |
| DMS-79- Small cell lung cancer | 100.0 | 100.0 | U937- Histiocytic lymphoma | 0.6 | 1.4 |
| NCI-H146- Small cell lung cancer | 8.5 | 8.9 | KU-812- Myelogenous leukemia | 0.1 | 0.2 |
| NCI-H526- Small cell lung cancer | 9.7 | 13.6 | 769-P- Clear cell renal carcinoma | 1.7 | 2.2 |
| NCI-N417- Small cell lung cancer | 2.5 | 2.9 | Caki-2- Clear cell renal carcinoma | 1.8 | 2.6 |
| NCI-H82- Small cell lung cancer | 1.5 | 1.7 | SW 839- Clear cell renal carcinoma | 2.1 | 2.2 |
| NCI-H157- Squamous cell lung cancer (metastasis) | 7.4 | 10.1 | G401- Wilms' tumor | 0.8 | 1.6 |
| NCI-H1155- Large cell lung cancer | 8.7 | 10.8 | Hs766T- Pancreatic carcinoma (LN metastasis) | 2.8 | 3.1 |
| NCI-H1299- Large cell lung cancer | 5.1 | 5.1 | CAPAN-1- Pancreatic adenocarcinoma (liver metastasis) | 3.3 | 3.4 |
| NCI-H727 Lung | 6.2 | 6.7 | SU86.86- Pancreatic carcinoma (liver metastasis) | 5.7 | 7.4 |
| NCI-UMC-11- Lung carcinoid | 17.8 | 15.4 | BxPC-3- Pancreatic adenocarcinoma | 7.1 | 10.0 |
| LX-1- Small cell lung cancer | 5.1 | 4.3 | HPAC- Pancreatic adenocarcinoma | 4.4 | 3.2 |
| Colo-205- Colon cancer | 3.5 | 4.5 | MIA PaCa-2- Pancreatic carcinoma | 0.8 | 1.6 |
| KM12- Colon cancer | 5.2 | 6.0 | CFPAC-1- Pancreatic ductal adenocarcinoma | 30.4 | 28.5 |
| KM20L2- Colon cancer | 1.3 | 0.9 | PANC-1- Pancreatic epithelioid ductal carcinoma | 3.8 | 3.7 |
| NCI-H716- Colon cancer | 10.8 | 13.9 | T24- Bladder carcinma (transitional cell) | 2.5 | 2.4 |
| SW-48- Colon adenocarcinoma | 1.6 | 1.3 | 5637- Bladder carcinoma | 5.7 | 6.0 |
| SW1116- Colon adenocarcinoma | 2.9 | 2.9 | HT-1197- Bladder carcinoma | 6.0 | 6.3 |
| LS 174T- Colon adenocarcinoma | 6.2 | 6.9 | UM-UC-3- Bladder carcinma (transitional cell) | 0.8 | 0.6 |
| SW-948- Colon adenocarcinoma | 0.7 | 0.6 | A204- Rhabdomyosarcoma | 0.9 | 1.2 |
| SW-480- Colon adenocarcinoma | 2.2 | 0.2 | HT-1080- Fibrosarcoma | 8.2 | 11.8 |
| NCI-SNU-5- Gastric carcinoma | 2.8 | 3.4 | MG-63- Osteosarcoma | 0.0 | 0.0 |
| KATO III- Gastric carcinoma | 3.3 | 6.3 | SK-LMS-1 Leiomyosarcoma (vulva) | 1.7 | 1.8 |
| NCI-SNU-16- Gastric carcinoma | 3.9 | 3.8 | SJRH30- Rhabdomyosarcoma (met to bone marrow) | 1.4 | 0.7 |
| NCI-SNU-1- Gastric carcinoma | 6.0 | 8.0 | A431- Epidermoid carcinoma | 4.1 | 5.6 |

TABLE 59-continued

Panel 3D

| Tissue Name | Rel. Exp.(%) Ag2872, Run 164543502 | Rel. Exp.(%) Ag2872, Run 164828587 | Tissue Name | Rel. Exp.(%) Ag2872, Run 164543502 | Rel. Exp.(%) Ag2872, Run 164828587 |
|---|---|---|---|---|---|
| RF-1- Gastric adenocarcinoma | 1.6 | 2.3 | WM266-4- Melanoma | 2.0 | 2.1 |
| RF-48- Gastric adenocarcinoma | 2.3 | 1.8 | DU 145- Prostate carcinoma (brain metastasis) | 0.3 | 0.1 |
| MKN-45- Gastric carcinoma | 7.0 | 7.6 | MDA-MB-468- Breast adenocarcinoma | 4.6 | 7.5 |
| NCI-N87- Gastric carcinoma | 4.4 | 4.8 | SCC-4- Squamous cell carcinoma of tongue | 0.8 | 0.4 |
| OVCAR-5- Ovarian carcinoma | 0.9 | 1.4 | SCC-9- Squamous cell carcinoma of tongue | 0.7 | 0.5 |
| RL95-2- Uterine carcinoma | 2.3 | 3.0 | SCC-15- Squamous cell carcinoma of tongue | 0.4 | 0.3 |
| HelaS3- Cervical adenocarcinoma | 1.4 | 2.2 | CAL 27- Squamous cell carcinoma of tongue | 3.1 | 3.4 |

TABLE 60

Panel 4.1D

| Tissue Name | Rel. Exp.(%) Ag4847, Run 223335762 | Tissue Name | Rel. Exp.(%) Ag4847, Run 223335762 |
|---|---|---|---|
| Secondary Th1 act | 12.2 | HUVEC IL-1 beta | 0.0 |
| Secondary Th2 act | 14.8 | HUVEC IFN gamma | 0.0 |
| Secondary Tr1 act | 9.5 | HUVEC TNF alpha + IFN gamma | 0.0 |
| Secondary Th1 rest | 2.6 | HUVEC TNF alpha + IL4 | 0.0 |
| Secondary Th2 rest | 8.7 | HUVEC IL-11 | 0.0 |
| Secondary Tr1 rest | 9.9 | Lung Microvascular EC none | 0.0 |
| Primary Th1 act | 2.1 | Lung Microvascular EC TNF alpha + IL-1 beta | 0.0 |
| Primary Th2 act | 14.2 | Microvascular Dermal EC none | 0.0 |
| Primary Tr1 act | 2.8 | Microsvasular Dermal EC TNF alpha + IL-1 beta | 0.0 |
| Primary Th1 rest | 2.7 | Bronchial epithelium TNF alpha + IL1 beta | 51.8 |
| Primary Th2 rest | 3.6 | Small airway epithelium none | 28.7 |
| Primary Tr1 rest | 19.1 | Small airway epithelium TNF alpha + IL-1 beta | 52.5 |
| CD45RA CD4 lymphocyte act | 5.3 | Coronery artery SMC rest | 0.0 |
| CD45RO CD4 lymphocyte act | 9.1 | Coronery artery SMC TNF alpha + IL-1 beta | 0.1 |
| CD8 lymphocyte act | 3.9 | Astrocytes rest | 16.7 |
| Secondary CD8 lymphocyte rest | 6.6 | Astrocytes TNF alpha + IL-1 beta | 9.7 |
| Secondary CD8 lymphocyte act | 2.4 | KU-812 (Basophil) rest | 0.3 |
| CD4 lymphocyte none | 0.5 | KU-812 (Basophil) PMA/ionomycin | 0.2 |
| 2ry Th1/Th2/Tr1__anti-CD95 CH11 | 7.0 | CCD1106 (Keratinocytes) none | 68.8 |
| LAK cells rest | 1.9 | CCD1106 (Keratinocytes) TNF alpha + IL-1 beta | 29.5 |
| LAK cells IL-2 | 6.3 | Liver cirrhosis | 4.1 |
| LAK cells IL-2 + IL-12 | 6.2 | NCI-H292 none | 27.7 |
| LAK cells IL-2 + IFN gamma | 4.0 | NCI-H292 IL-4 | 87.1 |
| LAK cells IL-2 + IL-18 | 3.5 | NCI-H292 IL-9 | 81.2 |
| LAK cells PMA/ionomycin | 3.3 | NCI-H292 IL-13 | 74.7 |
| NK Cells IL-2 rest | 5.1 | NCI-H292 IFN gamma | 35.4 |
| Two Way MLR 3 day | 1.6 | HPAEC none | 0.0 |
| Two Way MLR 5 day | 1.3 | HPAEC TNF alpha + IL-1 beta | 0.0 |
| Two Way MLR 7 day | 1.6 | Lung fibroblast none | 0.4 |
| PBMC rest | 3.8 | Lung fibroblast TNF alpha + IL-1 beta | 0.5 |
| PBMC PWM | 5.6 | Lung fibroblast IL-4 | 0.0 |

TABLE 60-continued

Panel 4.1D

| Tissue Name | Rel. Exp.(%) Ag4847, Run 223335762 | Tissue Name | Rel. Exp.(%) Ag4847, Run 223335762 |
|---|---|---|---|
| PBMC PHA-L | 13.0 | Lung fibroblast IL-9 | 0.0 |
| Ramos (B cell) none | 15.1 | Lung fibroblast IL-13 | 0.0 |
| Ramos (B cell) ionomycin | 15.5 | Lung fibroblast IFN gamma | 0.0 |
| B lymphocytes PWM | 9.2 | Dermal fibroblast CCD1070 rest | 0.0 |
| B lymphocytes CD40L and IL-4 | 42.0 | Dermal fibroblast CCD1070 TNF alpha | 6.2 |
| EOL-1 dbcAMP | 0.0 | Dermal fibroblast CCD1070 IL-1 beta | 0.0 |
| EOL-1 dbcAMP PMA/ionomycin | 0.0 | Dermal fibroblast IFN gamma | 0.0 |
| Dendritic cells none | 0.0 | Dermal fibroblast IL-4 | 0.0 |
| Dendritic cells LPS | 0.0 | Dermal Fibroblast rest | 0.0 |
| Dendritic cells anti-CD40 | 0.0 | Neutrophils TNFa + LPS | 0.0 |
| Monocytes rest | 0.0 | Neutrophils rest | 0.0 |
| Monocytes LPS | 0.0 | Colon | 0.7 |
| Macrophages rest | 0.0 | Lung | 8.8 |
| Macrophages LPS | 0.0 | Thymus | 32.5 |
| HUVEC none | 0.0 | Kidney | 100.0 |
| HUVEC starved | 0.0 | | |

TABLE 61

Panel 4D

| Tissue Name | Rel. Exp.(%) Ag2872, Run 159776802 | Tissue Name | Rel. Exp.(%) Ag2872, Run 159776802 |
|---|---|---|---|
| Secondary Th1 act | 6.7 | HUVEC IL-1 beta | 0.0 |
| Secondary Th2 act | 10.1 | HUVEC IFN gamma | 0.0 |
| Secondary Tr1 act | 10.7 | HUVEC TNF alpha + IFN gamma | 0.0 |
| Secondary Th1 rest | 2.1 | HUVEC TNF alpha + IL4 | 0.0 |
| Secondary Th2 rest | 4.2 | HUVEC IL-11 | 0.0 |
| Secondary Tr1 rest | 4.4 | Lung Microvascular EC none | 0.3 |
| Primary Th1 act | 6.2 | Lung Microvascular EC TNF alpha + IL-1 beta | 0.0 |
| Primary Th2 act | 6.0 | Microvascular Dermal EC none | 0.1 |
| Primary Tr1 act | 5.7 | Microsvasular Dermal EC TNF alpha + IL-1 beta | 0.0 |
| Primary Th1 rest | 15.2 | Bronchial epithelium TNF alpha + IL1 beta | 2.7 |
| Primary Th2 rest | 20.9 | Small airway epithelium none | 18.9 |
| Primary Tr1 rest | 18.9 | Small airway epithelium TNF alpha + IL-1 beta | 100.0 |
| CD45RA CD4 lymphocyte act | 6.2 | Coronery artery SMC rest | 0.1 |
| CD45RO CD4 lymphocyte act | 11.0 | Coronery artery SMC TNF alpha + IL-1 beta | 0.0 |
| CD8 lymphocyte act | 13.4 | Astrocytes rest | 17.9 |
| Secondary CD8 lymphocyte rest | 10.7 | Astrocytes TNF alpha + IL-1 beta | 16.0 |
| Secondary CD8 lymphocyte act | 7.5 | KU-812 (Basophil) rest | 0.3 |
| CD4 lymphocyte none | 2.6 | KU-812 (Basophil) PMA/ionomycin | 1.2 |
| 2ry Th1/Th2/Tr1_anti-CD95 CH11 | 8.5 | CCD1106 (Keratinocytes) none | 29.5 |
| LAK cells rest | 5.0 | CCD1106 (Keratinocytes) TNF alpha + IL-1 beta | 3.4 |
| LAK cells IL-2 | 10.7 | Liver cirrhosis | 4.2 |
| LAK cells IL-2 + IL-12 | 8.4 | Lupus kidney | 5.2 |
| LAK cells IL-2 + IFN gamma | 10.3 | NCI-H292 none | 55.1 |
| LAK cells IL-2 + IL-18 | 8.0 | NCI-H292 IL-4 | 77.4 |
| LAK cells PMA/ionomycin | 4.5 | NCI-H292 IL-9 | 70.2 |
| NK Cells IL-2 rest | 5.7 | NCI-H292 IL-13 | 37.1 |
| Two Way MLR 3 day | 6.0 | NCI-H292 IFN gamma | 27.4 |
| Two Way MLR 5 day | 4.4 | HPAEC none | 0.1 |

TABLE 61-continued

Panel 4D

| Tissue Name | Rel. Exp.(%) Ag2872, Run 159776802 | Tissue Name | Rel. Exp.(%) Ag2872, Run 159776802 |
|---|---|---|---|
| Two Way MLR 7 day | 5.9 | HPAEC TNF alpha + IL-1 beta | 0.0 |
| PBMC rest | 4.2 | Lung fibroblast none | 1.2 |
| PBMC PWM | 26.4 | Lung fibroblast TNF alpha + IL-1 beta | 1.4 |
| PBMC PHA-L | 19.2 | Lung fibroblast IL-4 | 1.2 |
| Ramos (B cell) none | 11.7 | Lung fibroblast IL-9 | 0.8 |
| Ramos (B cell) ionomycin | 56.3 | Lung fibroblast IL-13 | 0.4 |
| B lymphocytes PWM | 31.6 | Lung fibroblast IFN gamma | 0.7 |
| B lymphocytes CD40L and IL-4 | 22.5 | Dermal fibroblast CCD1070 rest | 1.7 |
| EOL-1 dbcAMP | 0.8 | Dermal fibroblast CCD1070 TNF alpha | 7.9 |
| EOL-1 dbcAMP PMA/ionomycin | 0.6 | Dermal fibroblast CCD1070 IL-1 beta | 0.4 |
| Dendritic cells none | 0.7 | Dermal fibroblast IFN gamma | 0.3 |
| Dendritic cells LPS | 0.0 | Dermal fibroblast IL-4 | 2.0 |
| Dendritic cells anti-CD40 | 0.1 | IBD Colitis 2 | 0.8 |
| Monocytes rest | 0.3 | IBD Crohn's | 1.6 |
| Monocytes LPS | 0.4 | Colon | 10.4 |
| Macrophages rest | 1.0 | Lung | 6.8 |
| Macrophages LPS | 0.8 | Thymus | 21.2 |
| HUVEC none | 0.0 | Kidney | 32.5 |
| HUVEC starved | 0.3 | | |

TABLE 62

Panel 5 Islet

| Tissue Name | Rel. Exp.(%) Ag2872, Run 237228677 | Tissue Name | Rel. Exp.(%) Ag2872, Run 237228677 |
|---|---|---|---|
| 97457_Patient-02go_adipose | 5.1 | 94709_Donor 2 AM - A_adipose | 1.8 |
| 97476_Patient-07sk_skeletal muscle | 2.7 | 94710_Donor 2 AM - B_adipose | 0.0 |
| 97477_Patient-07ut_uterus | 0.0 | 94711_Donor 2 AM - C_adipose | 0.0 |
| 97478 Patient-07pl_placenta | 39.5 | 94712_Donor 2 AD - A_adipose | 0.0 |
| 99167_Bayer Patient 1 | 97.9 | 94713_Donor 2 AD - B_adipose | 0.0 |
| 97482_Patient-08ut_uterus | 0.0 | 94714_Donor 2 AD - C adipose | 0.0 |
| 97483_Patient-08pl_placenta | 21.9 | 94742_Donor 3 U - A_Mesenchymal Stem Cells | 0.0 |
| 97486_Patient-09sk_skeletal muscle | 2.5 | 94743_Donor 3 U - B_Mesenchymal Stem Cells | 0.0 |
| 97487_Patient-09ut_uterus | 0.0 | 94730_Donor 3 AM - A_adipose | 0.0 |
| 97488_Patient-09pl_placenta | 19.3 | 94731_Donor 3 AM - B_adipose | 0.0 |
| 97492_Patient-10ut_uterus | 1.9 | 94732_Donor 3 AM - C _adipose | 0.0 |
| 97493_Patient-10pl_placenta | 100.0 | 94733_Donor 3 AD - A_adipose | 0.0 |
| 97495_Patient-11go_adipose | 4.0 | 94734_Donor 3 AD - B_adipose | 0.0 |
| 97496_Patient-11sk_skeletal muscle | 3.2 | 94735_Donor 3 AD - C_adipose | 0.0 |
| 97497_Patient-11ut_uterus | 1.7 | 77138_Liver_HepG2untreated | 46.0 |
| 97498_Patient-11pl_placenta | 23.8 | 73556_Heart_Cardiac stromal cells (primary) | 0.0 |
| 97500_Patient-12go_adipose | 1.6 | 81735_Small Intestine | 13.5 |
| 97501_Patient-12sk_skeletal muscle | 4.0 | 72409_Kidney_Proximal Convoluted Tubule | 17.1 |
| 97502_Patient-12ut_uterus | 0.0 | 82685_Small intestine_Duodenum | 1.4 |
| 97503_Patient-12pl_placenta | 20.3 | 90650_Adrenal_Adrenocortical adenoma | 1.6 |
| 94721 Donor 2 U - A_Mesenchymal Stem Cells | 0.0 | 72410_Kidney_HRCE | 90.1 |
| 94722_Donor 2 U - B_Mesenchymal Stem Cells | 0.0 | 72411_Kidney_HRE | 48.6 |

TABLE 62-continued

| Panel 5 Islet | | | |
|---|---|---|---|
| Tissue Name | Rel. Exp.(%) Ag2872, Run 237228677 | Tissue Name | Rel. Exp.(%) Ag2872, Run 237228677 |
| 94723_Donor 2 U - C_Mesenchymal Stem Cells | 0.0 | 73139_Uterus_Uterine smooth muscle cells | 2.9 |

TABLE 63

Panel CNS_1

| Tissue Name | Rel. Exp.(%) Ag2872, Run 171669734 | Tissue Name | Rel. Exp.(%) Ag2872, Run 171669734 |
|---|---|---|---|
| BA4 Control | 26.1 | BA17 PSP | 36.3 |
| BA4 Control2 | 50.0 | BA17 PSP2 | 10.2 |
| BA4 Alzheimer's2 | 9.3 | Sub Nigra Control | 8.8 |
| BA4 Parkinson's | 21.5 | Sub Nigra Control2 | 21.5 |
| BA4 Parkinson's2 | 100.0 | Sub Nigra Alzheimer's2 | 6.8 |
| BA4 Huntington's | 25.0 | Sub Nigra Parkinson's2 | 19.9 |
| BA4 Huntington's2 | 15.7 | Sub Nigra Huntington's | 36.9 |
| BA4 PSP | 18.7 | Sub Nigra Huntington's2 | 15.5 |
| BA4 PSP2 | 42.3 | Sub Nigra PSP2 | 4.7 |
| BA4 Depression | 13.7 | Sub Nigra Depression | 4.1 |
| BA4 Depression2 | 11.4 | Sub Nigra Depression2 | 6.2 |
| BA7 Control | 45.1 | Glob Palladus Control | 2.5 |
| BA7 Control2 | 38.2 | Glob Palladus Control2 | 7.7 |
| BA7 Alzheimer's2 | 9.7 | Glob Palladus Alzheimer's | 4.5 |
| BA7 Parkinson's | 16.5 | Glob Palladus Alzheimer's2 | 4.1 |
| BA7 Parkinson's2 | 43.8 | Glob Palladus Parkinson's | 33.2 |
| BA7 Huntington's | 52.5 | Glob Palladus Parkinson's2 | 5.1 |
| BA7 Huntington's2 | 36.3 | Glob Palladus PSP | 1.8 |
| BA7 PSP | 40.1 | Glob Palladus PSP2 | 3.7 |
| BA7 PSP2 | 27.7 | Glob Palladus Depression | 2.4 |
| BA7 Depression | 4.2 | Temp Pole Control | 16.6 |
| BA9 Control | 28.7 | Temp Pole Control2 | 47.0 |
| BA9 Control2 | 71.2 | Temp Pole Alzheimer's | 8.1 |
| BA9 Alzheimer's | 8.1 | Temp Pole Alzheimer's2 | 8.3 |
| BA9 Alzheimer's2 | 18.8 | Temp Pole Parkinson's | 27.0 |
| BA9 Parkinson's | 28.3 | Temp Pole Parkinson's2 | 28.9 |
| BA9 Parkinson's2 | 60.3 | Temp Pole Huntington's | 36.6 |
| BA9 Huntington's | 40.9 | Temp Pole PSP | 6.8 |
| BA9 Huntington's2 | 19.5 | Temp Pole PSP2 | 8.1 |
| BA9 PSP | 21.5 | Temp Pole Depression2 | 9.2 |
| BA9 PSP2 | 6.0 | Cing Gyr Control | 49.7 |
| BA9 Depression | 7.7 | Cing Gyr Control2 | 32.1 |
| BA9 Depression2 | 15.5 | Cing Gyr Alzheimer's | 11.0 |
| BA17 Control | 38.2 | Cing Gyr Alzheimer's2 | 10.1 |
| BA17 Control2 | 71.2 | Cing Gyr Parkinson's | 13.5 |
| BA17 Alzheimer's2 | 10.2 | Cing Gyr Parkinson's2 | 20.7 |
| BA17 Parkinson's | 29.1 | Cing Gyr Huntington's | 41.8 |
| BA17 Parkinson's2 | 51.4 | Cing Gyr Huntington's2 | 8.6 |
| BA17 Huntington's | 37.6 | Cing Gyr PSP | 9.7 |
| BA17 Huntington's2 | 18.6 | Cing Gyr PSP2 | 6.3 |
| BA17 Depression | 5.6 | Cing Gyr Depression | 10.3 |
| BA17 Depression2 | 35.6 | Cing Gyr Depression2 | 5.9 |

CNS_neurodegeneration_v1.0 Summary: Ag2872 This panel confirms the expression of the CG56071-01 gene at moderate level in the CNS in an independent group of patients. However, no differential expression was found between Alzheimer's disease and control postmortem brains in this experiment. Please see Panel 1.5 for a discussion of the potential utility of this gene in the central nervous system.

General_screening_panel_v1.5 Summary: Ag4847 Expression of the CG56071-01 gene is highest in the cerebellum (CT=25.4). Thus, the expression of this gene could be used to distinguish cerebellar brain tissue from other samples in the panel. This gene is also expressed at more moderate levels in other central nervous system tissues, including amygdala, hippocampus, cerebral cortex, substantia nigra, thalamus and spinal cord (CTs=27–30). This gene encodes a protein with homology to mixed lineage kinase 2. Mixed lineage kinase 2 is a mammalian protein kinase that activates stress-activated protein kinases/c-jun N-terminal kinases (SAPK/JNKs) through direct phosphorylation of their upstream activator, SEK1/JNKK. MAP kinase signaling pathways are important mediators of cellular responses to a wide variety of stimuli. Signals pass along these pathways via kinase cascades in which three protein kinases are sequentially phosphorylated and activated, initiating a range of cellular programs including cellular proliferation, endocrine, immune and inflammatory responses, and apoptosis. Furthermore, mixed lineage kinases have been implicated in neuronal apoptosis (ref. 1). Therefore, therapeutic downregulation/antagonism of this gene may slow neuronal apoptosis in diseases such as Alzheimer's, Huntington's and Parkinson's diseases.

This gene also shows substantial expression in cell lines derived from ovarian cancers when compared to normal ovary. Thus, therapeutic modulation of this gene or its protein product, through the use of small molecule drugs, antibodies or protein therapeutics, might be of benefit in the treatment of ovarian cancer.

In addition, this gene is expressed at low to moderate levels in endocrine and metabolic tissues including adipose, adrenal gland, liver, pancreas, pituitary gland, skeletal muscle and thyroid. Thus, therapeutic modulation of this gene or its protein product may be beneficial in the treatment of endocrine/metabolic-related disorders, such as obesity and diabetes. Interestingly, this gene is expressed at much higher levels in adult skeletal muscle (CT=30.5) than in fetal skeletal muscle (CT=35), suggesting that expression of this gene may be used to differentiate adult from fetal skeletal muscle (Xu Z, Maroney A C, Dobrzanski P, Kukekov N V, Greene L A. The MLK family mediates c-Jun N-terminal kinase activation in neuronal apoptosis. Mol Cell Biol 2001 Jul.; 21(14):4713–24).

Panel 1.3D Summary: Ag2872 Expression of the CG56071-01 gene was assessed in three independent experiments using the same probe/primer pair. Two of the three runs had good concordance; the third experiment was performed using a different machine and may explain the observed differences in expression. Overall this gene shows highest expression in samples derived from brain tissue, either normal tissue or cell lines derived from malignant brain tissue. Please see panel Panel 1.5 for a discussion of utility in the central nervous system.

In addition, there is substantial expression of this gene in a number of cancer cell lines, including ovarian cancer, breast cancer and renal cancer cell lines. Thus, the expression of this gene could be used to distinguish these samples from the other samples on this panel. Moreover, therapeutic modulation of the activity of this gene or its protein product, through the use of small molecule drugs, antibodies or protein therapeutics, might be of benefit in the treatment of ovarian, breast or renal cancer.

There is limited expression of this gene in endocrine/metabolic related tissues. Low expression of this gene is seen in adipose, pancreas, reproductive tissues (testes and ovaries) and skeletal muscle. Therefore, therapeutic modulation of this gene and/or its protein product may prove useful in the treatment of different endocrine/metabolic diseases, such as diabetes and obesity. Please refer to Panel 1.5 for a synopsis of the function of the MLK2 homolog.

Panel 2.2 Summary: Ag2872 Expression of the CG56071-01 gene is highest in a sample derived from normal kidney tissue adjacent to a kidney cancer (CT=31.2). In addition, there appears to be substantial expression of this gene in samples derived from breast cancers. Thus, expression of this gene could be used to distinguish normal kidney tissue from other tissues in the panel. Moreover, therapeutic modulation of the activity of this gene or its protein product, through the use of small molecule drugs, antibodies or protein therapeutics, might be of benefit in the treatment of breast cancer.

Panel 2D Summary: Ag2872 Expression of the CG56071-01 gene is highest in a sample derived from an ovarian cancer (CT=28.4). Thus, expression of this gene could be used to distinguish ovarian cancer tissue from the other tissues in the panel. In addition, there appears to be substantial expression of this gene in samples derived from breast cancers and well as a small but appreciable difference in expression between a set of colon cancers and their respective normal adjacent tissues. Therefore, therapeutic modulation of the activity of this gene or its protein product, through the use of small molecule drugs, antibodies or protein therapeutics, might be of benefit in the treatment of breast cancer, ovarian cancer or colon cancer.

Panel 3D Summary: Ag2872 The expression of the CG56071-01 gene was assessed in two independent runs in Panel 3D using one probe/primer pair. The two runs showed excellent concordance. This gene shows highest expression in a sample derived from a small cell lung cancer derived cell line (CT=26.1). In addition, there is substantial expression of this gene in two other lung cancer derived cell lines and a pancreatic cancer derived cell line. Thus, the expression of this gene could be used to distinguish this small cell lung cancer cell line from other samples in the panel. Moreover, therapeutic modulation of the activity of this gene or its protein product, through the use of small molecule drugs, antibodies or protein therapeutics, might be of benefit in the treatment of lung cancer.

Panel 4.1D Summary: Ag4847 Expression of the CG56071-01 gene is highest in kidney (CT=28.3). This gene is also highly expressed in small airway epithelium treated with TNF-a and IL-1b, and to a lower extent in the same non treated tissue and also in the mucoepidermoid cell line H292 upon treatment with the Th2 cytokines IL-4 and Il-9, cytokines that are responsible for increasing mucus production in this cell line. Furthermore, expression of this gene is up-regulated in bronchial epithelium upon TNF-a and IL-1 treatment. Finally, moderate expression of this gene is also seen in activated B cells.

This gene encodes for a protein with homology to the mixed lineage kinase 2 (MLK2) that was reported to activate JNK pathway (ref. 1). Activation of this pathway has been associated with many inflammatory reactions in many cell types. Il-1b that is produced during airway inflammation has been shown to regulate JNK pathway, for example (ref. 2). Furthermore, the role of Il-4 and IL-13 in airway remodeling appears also to use JNK pathway (ref. 3). Finally, JNK appears to be required for the production of metalloproteinases (ref. 4), molecules that play an important role in inflammatory diseases such as rheumatoid arthritis, asthma, and inflammatory bowel disease (IBD). Therefore, modulation of the expression or activity of the CG56071-01 gene or its protein product by small molecule drugs could be beneficial for the treatment of inflammatory diseases such as in chronic obstructive pulmonary disease, asthma, emphysema and also rheumatoid arthritis/osteoarthritis, IBD and psoriasis (Hirai S, Noda K, Moriguchi T, Nishida E, Yamashita A, Deyama T, Fukuyama K, Ohno S. Differential activation of two JNK activators, MKK7 and SEK1, by MKN28-derived nonreceptor serine/threonine kinase/mixed lineage kinase 2. J Biol Chem 1998 Mar. 27;273(13):7406–12; Hallsworth M P, Moir L M, Lai D, Hirst S J. Inhibitors of mitogen-activated protein kinases differentially regulate eosinophil-activating cytokine release from human airway smooth muscle. Am J Respir Crit Care Med 2000 Aug. 15;164(4):688–97; Hashimoto S, Gon Y, Takeshita I, Maruoka S, Horie T. IL-4 and IL-13 induce myofibroblastic phenotype of human lung fibroblasts through c-Jun NH2-terminal kinase-dependent pathway. J Allergy Clin Immunol 2001 June; 107(6): 1001–8; Han Z, Boyle D L, Chang L, Bennett B, Karin M, Yang L, Manning A M, Firestein G S. c-Jun N-terminal kinase is required for metalloproteinase expression and joint destruction in inflammatory arthritis. J Clin Invest 2001 July;108(1):73–81).

Panel 4D Summary: Ag2872 The results from this experiment are almost identical to what is seen in Panel 4.1D. Expression of the CG56071-01 gene is highest in small airway epithelium treated with TNF-a and IL-1b (CT=27.8). This gene is also expressed to a lower extent in untreated small airway epithelium tissue as well as in the mucoepidermoid cell line H292 upon treatment with the Th2 cytokines IL-4 and Il-9, cytokines that are responsible for increasing mucus production in this cell line. Furthermore, expression of this gene is up-regulated in bronchial epithelium upon TNF-a and IL-1 treatment. Finally, moderate expression of this gene is also seen in activated B cells.

This gene encodes for a protein with homology to the mixed lineage kinase 2 (MLK2) that was reported to activate JNK pathway (ref. 1). Activation of this pathway has been associated with many inflammatory reactions in many cell types. Il-1b that is produced during airway inflammation has been shown to regulate JNK pathway, for example (ref. 2). Furthermore, the role of Il-4 and IL-13 in airway remodeling appears also to use JNK pathway (ref. 3). Finally, JNK appears to be required for the production of metalloproteinases (ref. 4), molecules that play an important role in inflammatory diseases such as rheumatoid arthritis, asthma, and inflammatory bowel disease (IBD). Therefore, modulation of the expression or activity of the CG56071-01 gene or its protein product by small molecule drugs could be beneficial for the treatment of inflammatory diseases such as in chronic obstructive pulmonary disease, asthma, emphysema and also rheumatoid arthritis/osteoarthritis, IBD and psoriasis (Hirai S, Noda K, Moriguchi T, Nishida E, Yamashita A, Deyama T, Fukuyama K, Ohno S. Differential activation of two JNK activators, MKK7 and SEK1, by MKN28-derived nonreceptor serine/threonine kinase/mixed lineage kinase 2. J Biol Chem 1998 Mar 27;273(13):7406–12; Hallsworth M P, Moir L M, Lai D, Hirst S J. Inhibitors of mitogen-activated protein kinases differentially regulate eosinophil-activating cytokine release from human airway smooth muscle. Am J Respir Crit Care Med 2001 Aug. 15;164(4):688–97; Hashimoto S, Gon Y, Takeshita I, Maruoka S, Horie T. IL-4 and IL-13 induce myofibroblastic phenotype of human lung fibroblasts through c-Jun NH2-terminal kinase-dependent pathway. J Allergy Clin Immunol 2001 June; 107(6): 1001–8; Han Z, Boyle D L, Chang L, Bennett B, Karin M, Yang L, Manning A M, Firestein G S. c-Jun N-terminal kinase is required for metalloproteinase expression and joint destruction in inflammatory arthritis. J Clin Invest 2001 July; 108(1):73–81).

Panel 5 Islet Summary: Ag2872 The CG56071-01 gene is expressed at low to moderate levels in pancreatic islet cells and placenta in panel 5I. Please refer to Panel 1.5 for a synopsis of the potential function of this MLK2-like gene in endocrine and metabolic disorders.

Panel CNS_1 Summary: Ag2872 This panel confirms the low to moderate expression of the CG56071-01 gene in the CNS in an independent group of patients.

H. NOV10: Interleukin-1 Like Protein 1

Expression of the NOV10 gene (CG56083-01) was assessed using the primer-probe sets Ag2909 and Ag4936, described in Tables 64–65.

TABLE 64

Probe Name Ag2909

| Primers | Sequences | | Length | Start Position |
|---|---|---|---|---|
| Forward | 5'-gcatgtgtggagacagaagag-3' | (SEQ ID NO:226) | 21 | 205 |
| Probe | TET-5'-cttccctacagctggagcagccagt-3'-TAMRA | (SEQ ID NO:227) | 25 | 230 |
| Reverse | 5'-accaagatagagctccatgatg-3' | (SEQ ID NO:228) | 22 | 258 |

TABLE 65

Probe Name Ag4936

| Primers | Sequences | | Length | Start Position |
|---|---|---|---|---|
| Forward | 5'-ggcatgtgtggagcacgaag-3' | (SEQ ID NO:229) | 20 | 204 |
| Probe | TET-5'-cttccctacagctggagcagccagt-3'-TAMRA | (SEQ ID NO:230) | 25 | 230 |
| Reverse | 5'-ccaagatagagctccatgatgt-3' | (SEQ ID NO:231) | 22 | 257 |

CNS_neurodegeneration_v1.0 Summary: Ag2909 Expression of this gene is low/undetectable (CTs>35) across all of the samples on this panel (data not shown). Probe failure is also a possibility.

General_screening_panel_v1.4 Summary: Ag4936 Expression of this gene is low/undetectable (CTs>35) across all of the samples on this panel (data not shown). Probe failure is also a possibility.

Panel 1.3D Summary: Ag2909 Expression of this gene is low/undetectable (CTs>35) across all of the samples on this panel (data not shown). Probe failure is also a possibility.

Panel 2D Summary: Ag2909 Expression of this gene is low/undetectable (CTs>35) across all of the samples on this panel (data not shown). Probe failure is also a possibility.

Panel 4.1D Summary: Ag4936 Expression of this gene is low/undetectable (CTs>35) across all of the samples on this panel (data not shown). Probe failure is also a possibility.

Panel 4D Summary: Ag2909 Expression of this gene is low/undetectable (CTs>35) across all of the samples on this panel (data not shown). Probe failure is also a possibility.

I. NOV11: Interleukin 1 Signal Transducer-Like (also known as TRAF6-like)

Expression of gene CG56093-01 was assessed using the primer-probe set Ag2889, described in Table 66. Results of the RTQ-PCR runs are shown in Tables 67–71.

TABLE 66

Probe Name Ag2889

| Primers | Sequences | | Length | Start Position |
|---|---|---|---|---|
| Forward | 5'-gcaaaaccacgaagagataatg-3' | (SEQ ID NO:232) | 22 | 1346 |
| Probe | TET-5'-caaaccagagctgcttgctttccag-3'-TAMRA | (SEQ ID NO:233) | 25 | 1373 |
| Reverse | 5'-ttacatagccaaaaccttttgg-3' | (SEQ ID NO:234) | 22 | 1419 |

TABLE 67

CNS_neurodegeneration_v1.0

| Tissue Name | Rel. Exp. (%) Ag2889, Run 224116293 | Tissue Name | Rel. Exp. (%) Ag2889, Run 224116293 |
|---|---|---|---|
| AD 1 Hippo | 17.9 | Control (Path) 3 Temporal Ctx | 4.3 |
| AD 2 Hippo | 38.4 | Control (Path) 4 Temporal Ctx | 39.8 |
| AD 3 Hippo | 11.0 | AD 1 Occipital Ctx | 15.3 |
| AD 4 Hippo | 9.0 | AD 2 Occipital Ctx (Missing) | 0.0 |
| AD 5 Hippo | 87.1 | AD 3 Occipital Ctx | 7.6 |
| AD 6 Hippo | 54.7 | AD 4 Occipital Ctx | 12.8 |
| Control 2 Hippo | 13.6 | AD 5 Occipital Ctx | 13.6 |
| Control 4 Hippo | 9.9 | AD 6 Occipital Ctx | 35.6 |
| Control (Path) 3 Hippo | 9.0 | Control 1 Occipital Ctx | 3.6 |
| AD 1 Temporal Ctx | 32.5 | Control 2 Occipital Ctx | 40.1 |
| AD 2 Temporal Ctx | 40.3 | Control 3 Occipital Ctx | 21.3 |
| AD 3 Temporal Ctx | 11.3 | Control 4 Occipital Ctx | 7.4 |
| AD 4 Temporal Ctx | 33.2 | Control (Path) 1 Occipital Ctx | 100.0 |
| AD 5 Inf Temporal Ctx | 99.3 | Control (Path) 2 Occipital Ctx | 26.1 |

TABLE 67-continued

CNS_neurodegeneration_v1.0

| Tissue Name | Rel. Exp. (%) Ag2889, Run 224116293 | Tissue Name | Rel. Exp. (%) Ag2889, Run 224116293 |
|---|---|---|---|
| AD 5 Sup Temporal Ctx | 54.0 | Control (Path) 3 Occipital Ctx | 2.0 |
| AD 6 Inf Temporal Ctx | 49.7 | Control (Path) 4 Occipital Ctx | 27.0 |
| AD 6 Sup Temporal Ctx | 51.4 | Control 1 Parietal Ctx | 10.2 |
| Control 1 Temporal Ctx | 11.1 | Control 2 Parietal Ctx | 17.0 |
| Control 2 Temporal Ctx | 17.7 | Control 3 Parietal Ctx | 29.1 |
| Control 3 Temporal Ctx | 21.9 | Control (Path) 1 Parietal Ctx | 32.5 |
| Control 3 Temporal Ctx | 10.2 | Control (Path) 2 Parietal Ctx | 42.0 |
| Control (Path) 1 Temporal Ctx | 70.7 | Control (Path) 3 Parietal Ctx | 4.3 |
| Control (Path) 2 Temporal Ctx | 48.6 | Control (Path) 4 Parietal Ctx | 51.4 |

TABLE 68

Panel 1.3D

| Tissue Name | Rel. Exp. (%) Ag2889, Run 155754402 | Tissue Name | Rel. Exp. (%) Ag2889, Run 155754402 |
|---|---|---|---|
| Liver adenocarcinoma | 5.9 | Kidney (fetal) | 15.2 |
| Pancreas | 8.5 | Renal ca. 786-0 | 19.1 |
| Pancreatic ca. CAPAN 2 | 3.1 | Renal ca. A498 | 53.2 |
| Adrenal gland | 9.4 | Renal ca. RXF 393 | 6.9 |
| Thyroid | 16.4 | Renal ca. ACHN | 5.0 |
| Salivary gland | 8.1 | Renal ca. UO-31 | 16.8 |
| Pituitary gland | 17.7 | Renal ca. TK-10 | 8.0 |
| Brain (fetal) | 10.2 | Liver | 4.3 |
| Brain (whole) | 18.7 | Liver (fetal) | 9.2 |
| Brain (amygdala) | 16.6 | Liver ca. (hepatoblast) HepG2 | 11.1 |
| Brain (cerebellum) | 9.7 | Lung | 26.6 |
| Brain (hippocampus) | 74.7 | Lung (fetal) | 13.7 |
| Brain (substantia nigra) | 8.4 | Lung ca. (small cell) LX-1 | 17.6 |
| Brain (thalamus) | 15.2 | Lung ca. (small cell) NCI-H69 | 37.1 |
| Cerebral Cortex | 50.7 | Lung Ca. (s. cell var.) SHP-77 | 30.1 |

TABLE 68-continued

Panel 1.3D

| Tissue Name | Rel. Exp. (%) Ag2889, Run 155754402 | Tissue Name | Rel. Exp. (%) Ag2889, Run 155754402 |
|---|---|---|---|
| Spinal cord | 13.5 | Lung ca. (large cell) NCI-H460 | 2.9 |
| glio/astro U87-MG | 18.7 | Lung ca. (non-sm. cell) A549 | 21.3 |
| glio/astro U-118-MG | 56.6 | Lung ca. (non-s. cell) NCI-H23 | 14.8 |
| astrocytoma SW1783 | 16.8 | Lung ca. (non-s.cell) HOP-62 | 8.5 |
| neuro*; met SK-N-AS | 100.0 | Lung ca. (non-s. cl) NCI-H522 | 7.5 |
| astrocytoma SF-539 | 17.6 | Lung ca. (squam.) SW 900 | 3.8 |
| astrocytoma SNB-75 | 11.1 | Lung ca. (squam.) NCI-H596 | 8.8 |
| glioma SNB-19 | 27.0 | Mammary gland | 21.5 |
| glioma U251 | 18.8 | Breast ca.* (pl. ef) MCF-7 | 25.0 |
| glioma SF-295 | 8.7 | Breast ca.* (pl. ef) MDA-MB-231 | 72.2 |
| Heart (fetal) | 8.1 | Breast ca.* (pl. ef) T47D | 14.1 |
| Heart | 4.8 | Breast ca. BT-549 | 30.4 |
| Skeletal muscle (fetal) | 49.0 | Breast ca. MDA-N | 16.8 |
| Skeletal muscle | 4.8 | Ovary | 19.9 |
| Bone marrow | 9.5 | Ovarian ca. OVCAR-3 | 23.7 |
| Thymus | 21.8 | Ovarian ca. OVCAR-4 | 3.0 |
| Spleen | 32.5 | Ovarian ca. OVCAR-5 | 22.7 |
| Lymph node | 9.3 | Ovarian ca. OVCAR-8 | 17.4 |
| Colorectal | 15.9 | Ovarian ca. IGROV-1 | 5.0 |
| Stomach | 13.7 | Ovarian ca.* (ascites) SK-OV-3 | 31.6 |
| Small intestine | 20.0 | Uterus | 8.0 |
| Colon ca. SW480 | 34.2 | Placenta | 17.2 |
| Colon ca.* SW620 (SW480 met) | 21.0 | Prostate | 4.5 |
| Colon ca. HT29 | 12.9 | Prostate ca.* (bone met)PC-3 | 16.3 |
| Colon ca. HCT-116 | 15.5 | Testis | 27.5 |
| Colon ca. CaCo-2 | 18.8 | Melanoma Hs688(A).T | 6.3 |
| Colon ca. tissue (ODO3866) | 23.5 | Melanoma* (met) Hs688(B).T | 4.1 |
| Colon ca. HCC-2998 | 46.7 | Melanoma UACC-62 | 2.5 |
| Gastric ca.* (liver met) NCI-N87 | 34.4 | Melanoma M14 | 4.0 |
| Bladder | 20.0 | Melanoma LOX IMVI | 18.6 |
| Trachea | 22.5 | Melanoma* (met) SK-MEL-5 | 18.9 |
| Kidney | 5.1 | Adipose | 10.5 |

TABLE 69

Panel 2.2

| Tissue Name | Rel. Exp. (%) Ag2889, Run 175119377 | Tissue Name | Rel. Exp. (%) Ag2889, Run 175119377 |
|---|---|---|---|
| Normal Colon | 19.5 | Kidney Margin (OD04348) | 100.0 |
| Colon cancer (OD06064) | 31.9 | Kidney malignant cancer (OD06204B) | 7.0 |
| Colon Margin (OD06064) | 11.9 | Kidney normal adjacent tissue (OD06204E) | 14.5 |

TABLE 69-continued

Panel 2.2

| Tissue Name | Rel. Exp. (%) Ag2889, Run 175119377 | Tissue Name | Rel. Exp. (%) Ag2889, Run 175119377 |
|---|---|---|---|
| Colon cancer (OD06159) | 1.8 | Kidney Cancer (OD04450-01) | 81.2 |
| Colon Margin (OD06159) | 12.9 | Kidney Margin (OD04450-03) | 24.8 |
| Colon cancer (OD06297-04) | 6.6 | Kidney Cancer 8120613 | 3.0 |
| Colon Margin (OD06297-015) | 27.4 | Kidney Margin 8120614 | 6.4 |
| CC Gr. 2 ascend colon (ODO3921) | 6.4 | Kidney Cancer 9010320 | 3.3 |
| CC Margin (ODO3921) | 5.1 | Kidney Margin 9010321 | 2.5 |
| Colon cancer metastasis (OD06104) | 6.7 | Kidney Cancer 8120607 | 5.6 |
| Lung Margin (OD06104) | 11.3 | Kidney Margin 8120608 | 2.6 |
| Colon mets to lung (OD04451-01) | 16.0 | Normal Uterus | 39.0 |
| Lung Margin (OD04451-02) | 20.7 | Uterine Cancer 064011 | 10.8 |
| Normal Prostate | 4.1 | Normal Thyroid | 2.9 |
| Prostate Cancer (OD04410) | 3.4 | Thyroid Cancer 064010 | 3.8 |
| Prostate Margin (OD04410) | 7.1 | Thyroid Cancer A302152 | 12.8 |
| Normal Ovary | 8.4 | Thyroid Margin A302153 | 0.0 |
| Ovarian cancer (OD06283-03) | 6.2 | Normal Breast | 31.2 |
| Ovarian Margin (OD06283-07) | 10.7 | Breast Cancer (OD04566) | 3.6 |
| Ovarian Cancer 064008 | 11.7 | Breast Cancer 1024 | 4.3 |
| Ovarian cancer (OD06145) | 1.8 | Breast Cancer (OD04590-01) | 13.1 |
| Ovarian Margin (OD06145) | 20.2 | Breast Cancer Mets (OD04590-03) | 46.7 |
| Ovarian cancer (OD06455-03) | 11.7 | Breast Cancer Metastasis (OD04655-05) | 24.1 |
| Ovarian Margin (OD06455-07) | 9.3 | Breast Cancer 064006 | 13.0 |
| Normal Lung | 15.4 | Breast Cancer 9100266 | 13.9 |
| Invasive poor diff. lung adeno (ODO4945-01) | 5.4 | Breast Margin 9100265 | 9.3 |
| Lung Margin (ODO4945-03) | 15.7 | Breast Cancer A209073 | 7.0 |
| Lung Malignant Cancer (OD03126) | 10.1 | Breast Margin A2090734 | 21.9 |
| Lung Margin (OD03126) | 6.3 | Breast cancer (OD06083) | 30.4 |
| Lung Cancer (OD05014A) | 7.0 | Breast cancer node metastasis (OD06083) | 28.5 |
| Lung Margin (OD05014B) | 23.5 | Normal Liver | 19.3 |
| Lung cancer (OD06081) | 7.6 | Liver Cancer 1026 | 1.3 |
| Lung Margin (OD06081) | 20.9 | Liver Cancer 1025 | 12.2 |
| Lung Cancer (OD04237-01) | 8.0 | Liver Cancer 6004-T | 7.7 |
| Lung Margin (OD04237-02) | 32.8 | Liver Tissue 6004-N | 1.6 |
| Ocular Melanoma Metastasis | 30.6 | Liver Cancer 6005-T | 3.1 |
| Ocular Melanoma Margin (Liver) | 4.9 | Liver Tissue 6005-N | 18.3 |
| Melanoma Metastasis | 9.7 | Liver Cancer 064003 | 7.8 |

TABLE 69-continued

Panel 2.2

| Tissue Name | Rel. Exp. (%) Ag2889, Run 175119377 | Tissue Name | Rel. Exp. (%) Ag2889, Run 175119377 |
|---|---|---|---|
| Melanoma Margin (Lung) | 19.1 | Normal Bladder | 12.9 |
| Normal Kidney | 20.0 | Bladder Cancer 1023 | 1.3 |
| Kidney Ca, Nuclear grade 2 (OD04338) | 41.5 | Bladder Cancer A302173 | 7.9 |
| Kidney Margin (OD04338) | 14.9 | Normal Stomach | 37.6 |
| Kidney Ca Nuclear grade ½ (OD04339) | 49.0 | Gastric Cancer 9060397 | 1.0 |
| Kidney Margin (OD04339) | 13.8 | Stomach Margin 9060396 | 5.4 |
| Kidney Ca, Clear cell type (OD04340) | 22.1 | Gastric Cancer 9060395 | 7.4 |
| Kidney Margin (OD04340) | 28.9 | Stomach Margin 9060394 | 22.4 |
| Kidney Ca, Nuclear grade 3 (OD04348) | 6.7 | Gastric Cancer 064005 | 9.0 |

TABLE 70

Panel 2D

| Tissue Name | Rel. Exp. (%) Ag2889, Run 158095068 | Tissue Name | Rel. Exp. (%) Ag2889, Run 158095068 |
|---|---|---|---|
| Normal Colon | 75.3 | Kidney Margin 8120608 | 7.8 |
| CC Well to Mod Diff (ODO3866) | 7.9 | Kidney Cancer 8120613 | 9.5 |
| CC Margin (ODO3866) | 12.1 | Kidney Margin 8120614 | 7.5 |
| CC Gr. 2 rectosigmoid (ODO3868) | 7.4 | Kidney Cancer 9010320 | 15.3 |
| CC Margin (ODO3868) | 4.2 | Kidney Margin 9010321 | 10.4 |
| CC Mod Diff (ODO3920) | 37.1 | Normal Uterus | 9.7 |
| CC Margin (ODO3920) | 17.0 | Uterus Cancer 064011 | 30.8 |
| CC Gr.2 ascend colon (ODO3921) | 37.9 | Normal Thyroid | 22.8 |
| CC Margin (ODO3921) | 9.9 | Thyroid Cancer 064010 | 15.7 |
| CC from Partial Hepatectomy (ODO4309) Mets | 28.5 | Thyroid Cancer A302152 | 15.4 |
| Liver Margin (ODO4309) | 21.0 | Thyroid Margin A302153 | 36.3 |
| Colon mets to lung (OD04451-01) | 15.9 | Normal Breast | 25.7 |
| Lung Margin (OD04451-02) | 10.8 | Breast Cancer (OD04566) | 13.4 |
| Normal Prostate 6546-1 | 9.6 | Breast Cancer (OD04590-01) | 100.0 |
| Prostate Cancer (OD04410) | 26.4 | Breast Cancer Mets (OD04590-03) | 82.4 |
| Prostate Margin (OD04410) | 29.9 | Breast Cancer Metastasis (OD04655-05) | 31.6 |
| Prostate Cancer (OD04720-01) | 34.6 | Breast Cancer 064006 | 16.0 |

TABLE 70-continued

Panel 2D

| Tissue Name | Rel. Exp. (%) Ag2889, Run 158095068 | Tissue Name | Rel. Exp. (%) Ag2889, Run 158095068 |
|---|---|---|---|
| Prostate Margin (OD04720-02) | 47.3 | Breast Cancer 1024 | 19.6 |
| Normal Lung 061010 | 50.7 | Breast Cancer 9100266 | 24.0 |
| Lung Met to Muscle (ODO4286) | 11.0 | Breast Margin 9100265 | 9.7 |
| Muscle Margin (ODO4286) | 15.5 | Breast Cancer A209073 | 38.7 |
| Lung Malignant Cancer (OD03126) | 28.1 | Breast Margin A2090734 | 18.8 |
| Lung Margin (OD03126) | 39.0 | Normal Liver | 10.2 |
| Lung Cancer (OD04404) | 28.3 | Liver Cancer 064003 | 9.0 |
| Lung Margin (OD04404) | 14.4 | Liver Cancer 1025 | 9.2 |
| Lung Cancer (OD04565) | 15.0 | Liver Cancer 1026 | 4.5 |
| Lung Margin (OD04565) | 14.5 | Liver Cancer 6004-T | 16.5 |
| Lung Cancer (OD04237-01) | 51.4 | Liver Tissue 6004-N | 11.8 |
| Lung Margin (OD04237-02) | 20.7 | Liver Cancer 6005-T | 7.2 |
| Ocular Mel Met to Liver (ODO4310) | 62.9 | Liver Tissue 6005-N | 4.5 |
| Liver Margin (ODO4310) | 11.3 | Normal Bladder | 66.9 |
| Melanoma Mets to Lung (OD04321) | 15.9 | Bladder Cancer 1023 | 3.0 |
| Lung Margin (OD04321) | 39.8 | Bladder Cancer A302173 | 27.7 |
| Normal Kidney | 69.7 | Bladder Cancer (OD04718-01) | 39.2 |
| Kidney Ca, Nuclear grade 2 (OD04338) | 42.3 | Bladder Normal Adjacent (OD04718-03) | 18.0 |
| Kidney Margin (OD04338) | 39.0 | Normal Ovary | 6.5 |
| Kidney Ca Nuclear grade ½ (OD04339) | 62.4 | Ovarian Cancer 064008 | 42.9 |
| Kidney Margin (OD04339) | 59.9 | Ovarian Cancer (OD04768-07) | 57.0 |
| Kidney Ca, Clear cell type (OD04340) | 77.4 | Ovary Margin (OD04768-08) | 8.5 |
| Kidney Margin (OD04340) | 46.0 | Normal Stomach | 20.4 |
| Kidney Ca, Nuclear grade 3 (OD04348) | 10.1 | Gastric Cancer 9060358 | 8.3 |
| Kidney Margin (OD04348) | 33.9 | Stomach Margin 9060359 | 12.7 |
| Kidney Cancer (OD04622-01) | 9.0 | Gastric Cancer 9060395 | 27.9 |
| Kidney Margin (OD04622-03) | 2.8 | Stomach Margin 9060394 | 14.6 |
| Kidney Cancer (OD04450-01) | 27.4 | Gastric Cancer 9060397 | 14.2 |
| Kidney Margin (OD04450-03) | 45.4 | Stomach Margin 9060396 | 5.0 |
| Kidney Cancer 8120607 | 6.5 | Gastric Cancer 064005 | 76.8 |

TABLE 71

Panel 4D

| Tissue Name | Rel. Exp. (%) Ag2889, Run 158095071 | Tissue Name | Rel. Exp. (%) Ag2889, Run 158095071 |
|---|---|---|---|
| Secondary Th1 act | 22.8 | HUVEC IL-1beta | 11.9 |
| Secondary Th2 act | 23.8 | HUVEC IFN gamma | 17.3 |
| Secondary Tr1 act | 20.4 | HUVEC TNF alpha + IFN gamma | 21.0 |
| Secondary Th1 rest | 9.5 | HUVEC TNF alpha + IL4 | 17.4 |
| Secondary Th2 rest | 13.4 | HUVEC IL-11 | 7.5 |
| Secondary Tr1 rest | 10.1 | Lung Microvascular EC none | 6.9 |
| Primary Th1 act | 32.5 | Lung Microvascular EC TNFalpha + IL-1beta | 20.6 |
| Primary Th2 act | 29.5 | Microvascular Dermal EC none | 21.5 |
| Primary Tr1 act | 39.8 | Microsvasular Dermal EC TNFalpha + IL-1beta | 17.8 |
| Primary Th1 rest | 55.5 | Bronchial epithelium TNFalpha + IL1beta | 14.4 |
| Primary Th2 rest | 25.7 | Small airway epithelium none | 14.1 |
| Primary Tr1 rest | 21.6 | Small airway epithelium TNFalpha + IL-1beta | 100.0 |
| CD45RA CD4 lymphocyte act | 12.6 | Coronery artery SMC rest | 15.9 |
| CD45RO CD4 lymphocyte act | 33.9 | Coronery artery SMC TNFalpha + IL-1beta | 6.9 |
| CD8 lymphocyte act | 13.2 | Astrocytes rest | 13.6 |
| Secondary CD8 lymphocyte rest | 13.5 | Astrocytes TNFalpha + IL-1beta | 15.7 |
| Secondary CD8 lymphocyte act | 9.3 | KU-812 (Basophil) rest | 21.9 |
| CD4 lymphocyte none | 18.8 | KU-812 (Basophil) PMA/ionomycin | 65.1 |
| 2ry Th1/Th2/TR1_anti-CD95 CH11 | 13.6 | CCD1106 (Keratinocytes) none | 13.2 |
| LAK cells rest | 30.6 | CCD1106 (Keratinocytes) TNFalpha + IL-1beta | 7.3 |
| LAK cells IL-2 | 28.1 | Liver cirrhosis | 6.9 |
| LAK cells IL-2 + IL-12 | 21.0 | Lupus kidney | 4.9 |
| LAK cells IL-2 + IFN gamma | 28.3 | NCI-H292 none | 58.6 |
| LAK cells IL-2 + IL-18 | 42.9 | NCI-H292 IL-4 | 42.6 |
| LAK cells PMA/ionomycin | 14.1 | NCI-H292 IL-9 | 72.2 |
| NK Cells IL-2 rest | 23.3 | NCI-H292 IL-13 | 28.3 |
| Two Way MLR 3 day | 34.2 | NCI-H292 IFN gamma | 36.3 |
| Two Way MLR 5 day | 12.3 | HPAEC none | 12.2 |
| Two Way MLR 7 day | 4.7 | HPAEC TNF alpha + IL-1beta | 23.5 |
| PBMC rest | 14.1 | Lung fibroblast none | 7.2 |
| PBMC PWM | 68.3 | Lung fibroblast TNF alpha + IL-1beta | 7.0 |
| PBMC PHA-L | 19.8 | Lung fibroblast IL-4 | 21.9 |
| Ramos (B cell) none | 17.3 | Lung fibroblast IL-9 | 8.4 |
| Ramos (B cell) ionomycin | 59.5 | Lung fibroblast IL-13 | 12.4 |
| B lymphocytes PWM | 55.5 | Lung fibroblast IFN gamma | 28.1 |
| B lymphocytes CD40L and IL-4 | 32.1 | Dermal fibroblast CCD1070 rest | 24.3 |

TABLE 71-continued

Panel 4D

| Tissue Name | Rel. Exp. (%) Ag2889, Run 158095071 | Tissue Name | Rel. Exp. (%) Ag2889, Run 158095071 |
|---|---|---|---|
| EOL-1 dbcAMP | 13.6 | Dermal fibroblast CCD1070 TNF alpha | 54.7 |
| EOL-1 dbcAMP PMA/ionomycin | 37.4 | Dermal fibroblast CCD1070 IL-1beta | 10.9 |
| Dendritic cells none | 15.9 | Dermal fibroblast IFN gamma | 11.7 |
| Dendritic cells LPS | 14.1 | Dermal fibroblast IL-4 | 21.5 |
| Dendritic cells anti-CD40 | 11.7 | IBD Colitis 2 | 1.8 |
| Monocytes rest | 21.2 | IBD Crohn's | 3.0 |
| Monocytes LPS | 21.6 | Colon | 28.3 |
| Macrophages rest | 21.0 | Lung | 20.2 |
| Macrophages LPS | 16.4 | Thymus | 47.0 |
| HUVEC none | 18.0 | Kidney | 100.0 |
| HUVEC starved | 42.0 | | |

CNS_neurodegeneration_v1.0 Summary: Ag2889 This experiment confirms the expression of the CG56093-01 gene at moderate level in the CNS in an independent group of patients. However, no differential expression of this gene was found between Alzheimer's disease and control post-mortem brains. Please see Panel 1.3D for a discussion of utility of this gene in the central nervous system.

Panel 1.3D Summary: Ag2889 Expression of the CG56093-01 gene is highest in a sample derived from brain cancer cell line SK-N-AS (CT=27.9). Thus, expression of this gene could be used to distinguish SK-N-AS cell derived samples from other samples in the panel. In addition, there is substantial expression of this gene in samples derived from other brain cancer cell lines as well as in breast cancer and renal cancer cell lines. Therefore, therapeutic modulation of the activity of this gene or its protein product, through the use of small molecule drugs, antibodies or protein therapeutics, might be beneficial in the treatment of brain cancer, breast cancer and renal cancer.

This gene is also expressed at moderate levels in all regions of the central nervous system examined, including amygdala, cerebellum, hippocampus, substantia nigra, thalamus, cerebral cortex and spinal cord (CTs=28.3–31.4). This gene encodes a protein with homology to interleukin 1 signal transducer, also known as TRAF6. Interleukin 1 signal transducer is an important molecule involved in different aspects of cellular regulation, including inflammation. Inflammation has been implicated in the pathophysiology of Alzheimer's disease, stroke, and spinal cord and brain trauma. Therefore, therapeutic modulation of this gene or its protein product may be beneficial in reducing the neuronal death associated with any of these conditions.

In addition, the CG56093-01 gene expressed at moderate levels in several metabolic and endocrine tissues, including adipose, adrenal gland, liver, pancreas, skeletal muscle and thyroid. Therefore, therapeutic modulation of the activity of this gene or its protein product could be beneficial in the treatment of endocrine or metabolic diseases, such as obesity and type II diabetes. Interestingly, this gene is expressed at higher levels in fetal skeletal muscle (CT=28.9) than in adult skeletal muscle (CT=32.2), suggesting that expression of this gene can be used to distinguish these tissues. In addition, the relative overexpression of this gene in fetal skeletal muscle suggests that the protein product may enhance muscular growth or development in the fetus and thus may also act in a regenerative capacity in the adult. Therefore, therapeutic modulation of the protein encoded by this gene could be useful in treatment of muscle related diseases. More specifically, treatment of weak or dystrophic muscle with the protein encoded by this gene could restore muscle mass or function.

Panel 2.2 Summary: Ag2889 Expression of the CG56093-01 gene is highest in a sample derived from a sample of normal tissue adjacent to a kidney cancer (CT=32.1). Thus, expression of this gene could be used to distinguish this normal kidney tissue sample from other samples in the panel. In addition, there is low but significant expression of this gene in samples derived from kidney cancer, normal stomach tissue, normal uterus tissue, normal breast tissue and breast cancer tissue. Therefore, therapeutic modulation of the activity of this gene or its protein product, through the use of small molecule drugs, protein therapeutics or antibodies, might be beneficial in the treatment of kidney cancer or breast cancer.

Panel 2D Summary: Ag2889 Expression of the CG56093-01 gene is highest in a sample derived from breast cancer tissue (CT=28.7). Thus, the expression of this gene could be used to distinguish breast cancer tissue sample from other samples in the panel. In addition, there is substantial expression of this gene in samples derived from other breast cancer tissues, kidney cancer, gastric cancer tissue, normal bladder tissue, and normal colon tissue. Therefore, therapeutic modulation of the activity of this gene or its protein product, through the use of small molecule drugs, protein therapeutics or antibodies, might be beneficial in the treatment of kidney cancer, gastric cancer or breast cancer.

Panel 4D Summary: Ag2889 The CG56093-01 gene is expressed at moderate levels in the majority of samples on this panel. However, expression of this gene is highest in small airway epithelium treated with TNF-alpha and IL-1 beta (CT=27). This gene encodes a protein with homology to IL-1 signal transducer protein (also known as TRAF6), a protein involved in IL-1 and TNF receptor signaling. Therefore, modulation of the expression or activity of this protein by small molecule drugs could block the functions of B cells, T cells, and monocytes as well as block the generation of inflammatory cytokines from damaged lung epithelium, leading to the improvement of symptoms of patients suffering from autoimmune and inflammatory diseases such as asthma, chronic obstructive pulmonary diseases, emphysema, allergies, inflammatory bowel disease, lupus erythematosus, or rheumatoid arthritis.

I. NOV13: Glucuronosyltransferase

Expression of gene CG56097-01 was assessed using the primer-probe set Ag2907, described in Table 72. Results of the RTQ-PCR runs are shown in Tables 73–76.

TABLE 72

Probe Name Ag2907

| Primers | Sequences | | Length | Start Position |
|---|---|---|---|---|
| Forward | 5'-ggctcattcgaaactactggta-3' | (SEQ ID NO:235) | 22 | 773 |
| Probe | TET-5'-tggaatttcctcgcccactcttacct-3'-TAMRA | (SEQ ID NO:236) | 26 | 797 |
| Reverse | 5'-ggttgacaggtttgcagtagag-3' | (SEQ ID NO:237) | 22 | 844 |

TABLE 73

Panel 1.3D

| Tissue Name | Rel. Exp.(%) Ag2907, Run 157283423 | Rel. Exp.(%) Ag2907, Run 165701505 | Tissue Name | Rel. Exp.(%) Ag2907, Run 157283423 | Rel. Exp.(%) Ag2907, Run 165701505 |
|---|---|---|---|---|---|
| Liver adenocarcinoma | 0.0 | 0.0 | Kidney (fetal) | 0.0 | 0.0 |
| Pancreas | 0.0 | 0.0 | Renal ca. 786-0 | 0.0 | 0.0 |
| Pancreatic ca. CAPAN 2 | 0.0 | 0.0 | Renal ca. A498 | 0.0 | 0.0 |
| Adrenal gland | 0.0 | 0.0 | Renal ca. RXF 393 | 0.0 | 0.0 |
| Thyroid | 0.0 | 0.0 | Renal Ca. ACHN | 0.0 | 0.0 |
| Salivary gland | 0.0 | 0.0 | Renal ca. UO-31 | 0.0 | 0.0 |
| Pituitary gland | 100.0 | 100.0 | Renal ca. TK-10 | 2.0 | 28.3 |
| Brain (fetal) | 0.0 | 0.0 | Liver | 0.0 | 0.0 |
| Brain (whole) | 0.0 | 14.3 | Liver (fetal) | 0.0 | 0.0 |
| Brain (amygdala) | 0.0 | 0.0 | Liver ca. (hepatoblast) HepG2 | 0.0 | 0.0 |
| Brain (cerebellum) | 0.0 | 11.9 | Lung | 0.0 | 0.0 |
| Brain (hippocampus) | 1.9 | 0.0 | Lung (fetal) | 0.0 | 0.0 |
| Brain (substantia nigra) | 0.0 | 0.0 | Lung ca. (small cell) LX-1 | 0.0 | 0.0 |
| Brain (thalamus) | 0.0 | 0.0 | Lung ca. (small cell) NCI-H69 | 1.1 | 0.0 |
| Cerebral Cortex | 2.0 | 0.0 | Lung ca. (s.cell var.) SHP-77 | 0.0 | 0.0 |
| Spinal cord | 1.3 | 0.0 | Lung ca. (large cell)NCI-H460 | 0.0 | 0.0 |
| glio/astro U87-MG | 0.0 | 12.2 | Lung ca. (non-sm. cell) A549 | 0.0 | 0.0 |

TABLE 73-continued

Panel 1.3D

| Tissue Name | Rel. Exp.(%) Ag2907, Run 157283423 | Rel. Exp.(%) Ag2907, Run 165701505 | Tissue Name | Rel. Exp.(%) Ag2907, Run 157283423 | Rel. Exp.(%) Ag2907, Run 165701505 |
|---|---|---|---|---|---|
| glio/astro U-118-MG | 0.0 | 0.0 | Lung ca. (non-s.cell) NCI-H23 | 0.0 | 0.0 |
| astrocytoma SW1783 | 0.0 | 0.0 | Lung ca. (non-s.cell) HOP-62 | 0.0 | 0.0 |
| neuro*; met SK-N-AS | 1.0 | 0.0 | Lung ca. (non-s.cl) NCI-H522 | 0.0 | 0.0 |
| astrocytoma SF-539 | 1.4 | 0.0 | Lung ca. (squam.) SW 900 | 0.9 | 0.0 |
| astrocytoma SNB-75 | 1.0 | 0.0 | Lung ca. (squam.) NCI-H596 | 0.0 | 0.0 |
| glioma SNB-19 | 1.8 | 0.0 | Mammary gland | 0.0 | 0.0 |
| glioma U251 | 0.8 | 0.0 | Breast ca.* (pl.ef) MCF-7 | 1.4 | 2.5 |
| glioma SF-295 | 1.0 | 0.0 | Breast ca.* (pl.et) MDA-MB-231 | 2.6 | 0.0 |
| Heart (fetal) | 0.0 | 0.0 | Breast ca.* (pl.et) T47D | 0.0 | 0.0 |
| Heart | 0.0 | 0.0 | Breast ca. BT-549 | 3.3 | 0.0 |
| Skeletal muscle (fetal) | 1.0 | 0.0 | Breast ca. MDA-N | 0.0 | 0.0 |
| Skeletal muscle | 0.0 | 0.0 | Ovary | 0.0 | 0.0 |
| Bone marrow | 0.0 | 0.0 | Ovarian ca. OVCAR-3 | 2.9 | 0.0 |
| Thymus | 0.0 | 0.0 | Ovarian ca. OVCAR-4 | 0.0 | 0.0 |
| Spleen | 0.9 | 0.0 | Ovarian ca. OVCAR-5 | 3.0 | 10.9 |
| Lymph node | 0.0 | 0.0 | Ovarian ca. OVCAR-8 | 0.0 | 0.0 |
| Colorectal | 0.0 | 0.0 | Ovarian ca. IGROV-1 | 0.0 | 0.0 |
| Stomach | 0.0 | 0.0 | Ovarian ca.* (ascites) SK-OV-3 | 0.0 | 0.0 |
| Small intestine | 0.0 | 0.0 | Uterus | 0.0 | 0.0 |
| Colon ca. SW480 | 0.0 | 0.0 | Placenta | 0.9 | 0.0 |
| Colon ca.* SW620(SW480 met) | 0.0 | 0.0 | Prostate | 0.0 | 0.0 |
| Colon ca. HT29 | 1.0 | 0.0 | Prostate ca.* (bone met)PC-3 | 1.3 | 0.0 |
| Colon ca. HCT-116 | 0.0 | 0.0 | Testis | 16.6 | 9.5 |
| Colon Ca. CaCo-2- | 1.0 | 0.0 | Melanoma Hs688(A).T | 0.0 | 0.0 |
| Colon Ca. tissue(ODO3866) | 0.0 | 11.0 | Melanoma* (met) Hs688(B).T | 0.0 | 0.0 |
| Colon ca. HCC-2998 | 2.6 | 0.0 | Melanoma UACC-62 | 0.0 | 0.0 |
| Gastic ca.* (liver met) NCI-N87 | 1.2 | 13.3 | Melanoma M14 | 0.0 | 0.0 |
| Bladder | 0.0 | 6.7 | Melanoma LOX IMVI | 0.0 | 0.0 |
| Trachea | 0.0 | 0.0 | Melanoma* (met) SK-MEL-5 | 0.0 | 0.0 |
| Kidney | 0.0 | 0.0 | Adipose | 1.5 | 0.0 |

TABLE 74

Panel 2D

| Tissue Name | Rel. Exp. (%) Ag2907, Run 157284121 | Tissue Name | Rel. Exp. (%) Ag2907, Run 157284121 |
|---|---|---|---|
| Normal Colon | 4.5 | Kidney Margin 8120608 | 0.0 |
| CC Well to Mod Diff (ODO3866) | 2.1 | Kidney Cancer 8120613 | 0.0 |

TABLE 74-continued

Panel 2D

| Tissue Name | Rel. Exp. (%) Ag2907, Run 157284121 | Tissue Name | Rel. Exp. (%) Ag2907, Run 157284121 |
|---|---|---|---|
| CC Margin (ODO3866) | 2.3 | Kidney Margin 8120614 | 0.0 |

TABLE 74-continued

Panel 2D

| Tissue Name | Rel. Exp. (%) Ag2907, Run 157284121 | Tissue Name | Rel. Exp. (%) Ag2907, Run 157284121 |
|---|---|---|---|
| CC Gr. 2 rectosigmoid (ODO3868) | 1.7 | Kidney Cancer 9010320 | 0.0 |
| CC Margin (ODO3868) | 0.0 | Kidney Margin 9010321 | 4.8 |
| CC Mod Diff (ODO3920) | 0.0 | Normal Uterus | 0.0 |
| CC Margin (ODO3920) | 0.0 | Uterus Cancer 064011 | 1.5 |
| CC Gr. 2 ascend colon (ODO3921) | 0.0 | Normal Thyroid | 0.0 |
| CC Margin (ODO3921) | 6.8 | Thyroid Cancer 064010 | 0.0 |
| CC from Partial Hepatectomy (ODO4309) Mets | 0.0 | Thyroid Cancer A302152 | 0.0 |
| Liver Margin (ODO4309) | 0.0 | Thyroid Margin A302153 | 15.2 |
| Colon mets to lung (OD04451-01) | 0.0 | Normal Breast | 1.7 |
| Lung Margin (OD04451-02) | 0.0 | Breast Cancer (OD04566) | 0.0 |
| Normal Prostate 6546-1 | 0.0 | Breast Cancer (OD04590-01) | 0.0 |
| Prostate Cancer (OD04410) | 0.0 | Breast Cancer Mets (OD04590-03) | 2.2 |
| Prostate Margin (OD04410) | 0.0 | Breast Cancer Metastasis (OD04655-05) | 2.8 |
| Prostate Cancer (OD04720-01) | 100.0 | Breast Cancer 064006 | 0.0 |
| Prostate Margin (OD04720-02) | 0.0 | Breast Cancer 1024 | 0.0 |
| Normal Lung 061010 | 7.2 | Breast Cancer 9100266 | 2.4 |
| Lung Met to Muscle (ODO4286) | 0.6 | Breast Margin 9100265 | 0.0 |
| Muscle Margin (ODO4286) | 0.0 | Breast Cancer A209073 | 0.0 |
| Lung Malignant Cancer (OD03126) | 3.4 | Breast Margin A2090734 | 0.0 |
| Lung Margin (OD03126) | 0.0 | Normal Liver | 0.0 |
| Lung Cancer (OD04404) | 0.0 | Liver Cancer 064003 | 3.5 |
| Lung Margin (OD04404) | 4.1 | Liver Cancer 1025 | 0.0 |
| Lung Cancer (OD04565) | 0.0 | Liver Cancer 1026 | 0.0 |
| Lung Margin (OD04565) | 0.0 | Liver Cancer 6004-T | 0.0 |
| Lung Cancer (OD04237-01) | 0.0 | Liver Tissue 6004-N | 0.5 |
| Lung Margin (OD04237-02) | 0.0 | Liver Cancer 6005-T | 0.0 |
| Ocular Mel Met to Liver (ODO4310) | 0.0 | Liver Tissue 6005-N | 0.0 |
| Liver Margin (ODO4310) | 0.0 | Normal Bladder | 0.0 |
| Melanoma Mets to Lung (OD04321) | 0.0 | Bladder Cancer 1023 | 0.0 |
| Lung Margin (OD04321) | 0.0 | Bladder Cancer A302173 | 22.1 |
| Normal Kidney | 0.0 | Bladder Cancer (OD04718-01) | 2.4 |
| Kidney Ca, Nuclear grade 2 (OD04338) | 2.0 | Bladder Normal Adjacent (OD04718-03) | 0.0 |

TABLE 74-continued

Panel 2D

| Tissue Name | Rel. Exp. (%) Ag2907, Run 157284121 | Tissue Name | Rel. Exp. (%) Ag2907, Run 157284121 |
|---|---|---|---|
| Kidney Margin (OD04338) | 0.0 | Normal Ovary | 0.0 |
| Kidney Ca Nuclear grade ½ (OD04339) | 2.0 | Ovarian Cancer 064008 | 0.0 |
| Kidney Margin (OD04339) | 0.0 | Ovarian Cancer (OD04768-07) | 14.4 |
| Kidney Ca, Clear cell type (OD04340) | 0.0 | Ovary Margin (OD04768-08) | 0.0 |
| Kidney Margin (OD04340) | 2.4 | Normal Stomach | 0.0 |
| Kidney Ca, Nuclear grade 3 (OD04348) | 0.0 | Gastric Cancer 9060358 | 0.0 |
| Kidney Margin (OD04348) | 0.0 | Stomach Margin 9060359 | 0.0 |
| Kidney Cancer (OD04622-01) | 0.0 | Gastric Cancer 9060395 | 0.0 |
| Kidney Margin (OD04622-03) | 0.0 | Stomach Margin 9060394 | 0.0 |
| Kidney Cancer (OD04450-01) | 0.0 | Gastric Cancer 9060397 | 0.0 |
| Kidney Margin (OD04450-03) | 0.0 | Stomach Margin 9060396 | 0.0 |
| Kidney Cancer 8120607 | 2.1 | Gastric Cancer 064005 | 2.9 |

TABLE 75

Panel 3D

| Tissue Name | Rel. Exp. (%) Ag2907, Run 164633936 | Tissue Name | Rel. Exp. (%) Ag2907, Run 16433936 |
|---|---|---|---|
| Daoy-Medulloblastoma | 0.0 | Ca Ski-Cervical epidermoid carcinoma (metastasis) | 49.7 |
| TE671-Medulloblastoma | 0.0 | ES-2-Ovarian clear cell carcinoma | 0.0 |
| D283 Med-Medulloblastoma | 0.0 | Ramos-Stimulated with PMA/ionomycin 6h | |
| PFSK-1-Primitive Neuroectodermal | 15.7 | Ramos-Stimulated with PMA/ionomycin 14h | 0.0 |
| XF-498-CNS | 0.0 | MEG-01-Chronic myelogenous leukemia (megokaryoblast) | 0.0 |
| SNB-78-Glioma | 0.0 | Raji-Burkitt's lymphoma | 0.0 |
| SF-268-Glioblastoma | 0.0 | Daudi-Burkitt's lymphoma | 0.0 |
| T98G-Glioblastoma | 0.0 | U266-B-cell plasmacytoma | 0.0 |
| SK-N-SH-Neuroblastoma (metastasis) | 0.0 | CA46-Burkitt's lymphoma | 0.0 |
| SF-295-Glioblastoma | 0.0 | RL-non-Hodgkin's B-cell lymphoma | 49.7 |
| Cerebellum | 0.0 | JM1-pre-B-cell lymphoma | 0.0 |
| Cerebellum | 0.0 | Jurkat-T cell leukemia | 0.0 |
| NCI-H292-Mucoepidermoid lung carcinoma | 94.0 | TF-1-Erythroleukemia | 0.0 |
| DMS-114-Small cell lung cancer | 0.0 | HUT 78-T-cell lymphoma | 0.0 |
| DMS-79-Small cell lung cancer | 0.0 | U937-Histiocytic lymphoma | 0.0 |

TABLE 75-continued

| Panel 3D | | | |
|---|---|---|---|
| Tissue Name | Rel. Exp. (%) Ag2907, Run 164633936 | Tissue Name | Rel. Exp. (%) Ag2907, Run 16433936 |
| NCI-H146-Small cell lung cancer | 0.0 | KU-812-Mydogenous leukemia | 0.0 |
| NCI-H526-Small cell lung cancer | 0.0 | 769-P-Clear cell renal carcinoma | 27.2 |
| NCI-N417- Small cell lung cancer | 0.0 | Caki-2-Clear cell renal carcinoma | 0.0 |
| NCI-H82-Small cell lung cancer | 0.0 | SW 839-Clear cell renal carcinomal | 0.0 |
| NCI-H157-Squamous cell lung cancer (metastasis) | 0.0 | G401-Wilms' tumor | 0.0 |
| NCI-H1155-Large cell lung cancer | 0.0 | Hs766T-Pancreatic carcinoma (LN metastasis) | 0.0 |
| NCI-H1299-Large cell lung cancer | 16.4 | CAPAN-1-Pancreatic adenocarcinoma (liver metastasis) | 0.0 |
| NCI-H727-Lung carcinoid | 0.0 | SU86.86-Pancreatic carcinoma (liver metastasis) | 0.0 |
| NCI-UMC-11-Lung carcinoid | 0.0 | BxPC-3-Pancreatic adenocarcinoma | 0.0 |
| LX-1-Small cell lung cancer | 0.0 | HPAC-Pancreatic adenocarcinoma | 0.0 |
| Colo-205-Colon cancer | 0.0 | MIA PaCa-2-Pancreatic carcinoma | 0.0 |
| KM12-Colon cancer | 0.0 | CFPAC-1-Pancreatic ductal adenocarcinoma | 0.0 |
| KM20L2-Colon cancer | 0.0 | PANC-1-Pancreatic epithelioid ductal carcinoma | 0.0 |
| NCI-H716-Colon cancer | 0.0 | T24-Bladder carcinma (transitional cell) | 0.0 |
| SW-48-Colon adenocarcinoma | 0.0 | 5637-Bladder carcinoma | 0.0 |
| SW1116-Colon adenocarcinoma | 0.0 | HT-1197-Bladder carcinoma | 17.6 |
| LS 174T-Colon adenocarcinoma | 0.0 | UM-UC-3-Bladder carcinma (transitional cell) | 0.0 |
| SW-948-Colon adenocarcinoma | 0.0 | A204-Rhabdomyosarcoma | 0.0 |
| SW-480-Colon adenocarcinoma | 0.0 | HT-1080-Fibrosarcoma | 0.0 |
| NCI-SNU-5-Gastric carcinoma | 0.0 | MG-63-Osteosarcoma | 0.0 |
| KATO III-Gastric carcinoma | 0.0 | SK-LMS-1-Leiomyosarcoma (vulva) | 0.0 |
| NCI-SNU-16-Gastric carcinoma | 0.0 | SJRH30-Rhabdomyosarcoma (met to bone marrow) | 0.0 |
| NCI-SNU-1-Gastric carcinoma | 0.0 | A431-Epidermoid carcinoma | 0.0 |
| RF-1-Gastric adenocarcinoma | 0.0 | WM266-4-Melanoma | 0.0 |
| RF-48-Gastric adenocarcinoma | 0.0 | DU 145-Prostate carcinoma (brain metastasis) | 0.0 |
| MKN-45-Gastric carcinoma | 0.0 | MDA-MB-468-Breast adenocarcinoma | 37.6 |
| NCI-N87-Gastric carcinoma | 0.0 | SCC-4-Squamous cell carcinoma of tongue | 0.0 |
| OVCAR-5-Ovarian carcinoma | 0.0 | SCC-9-Squamous cell carcinoma of tongue | 0.0 |
| RL95-2-Uterine carcinoma | 0.0 | SCC-15-Squamous cell carcinoma of tongue | 0.0 |
| HelaS3-Cervical adenocarcinoma | 0.0 | CAL-27-Squamous cell carcinoma of tongue | 100.0 |

TABLE 76

| Panel 4D | | | |
|---|---|---|---|
| Tissue Name | Rel. Exp. (%) Ag2907, Run 157284733 | Tissue Name | Rel. Exp. (%) Ag2907, Run 157284733 |
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 12.3 | Lung Microvascular EC TNFalpha + IL-1beta | 10.4 |
| Primary Th2 act | 0.0 | Microvascular Dermal EC none | 11.2 |
| Primary Tr1 act | 0.0 | Microvascular Dermal EC TNFalpha + IL-1beta | 0.0 |
| Primary Th1 rest | 11.7 | Bronchial epithelium TNFalpha + IL1beta | 12.9 |
| Primary Th2 rest | 0.0 | Small airway epithelium none | 24.0 |
| Primary Tr1 rest | 0.0 | Small airway epithelium TNFalpha + IL-1beta | 100.0 |
| CD45RA CD4 lymphocyte act | 0.0 | Coronery artery SMC rest | 0.0 |
| CD45RO CD4 lymphocyte act | 6.1 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 12.0 |
| Secondary CD8 lymphocyte act | 0.0 | KU-812 (Basophil) rest | 0.0 |
| CD4 lymphocyte none | 4.5 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 0.0 |
| LAK cells IL-2 | 13.4 | Liver cirrhosis | 35.1 |
| LAK cells IL-2 + IL-12 | 0.0 | Lupus kidney | 0.0 |
| LAK cells IL-2 + IFN gamma | 0.0 | NCI-H292 none | 33.0 |
| LAK cells IL-2 + IL-18 | 0.0 | NCI-H292 IL-4 | 36.6 |
| LAK cells PMA/ionomycin | 0.0 | NCI-H292 IL-9 | 23.3 |
| NK Cells IL-2 rest | 0.0 | NCI-H292 IL-13 | 21.2 |
| Two Way MLR 3 day | 0.0 | NCI-H292 IFN gamma | 11.6 |
| Two Way MLR 5 day | 0.0 | HPAEC none | 13.3 |
| Two Way MLR 7 day | 0.0 | HPAEC TNF alpha + IL-1beta | 0.0 |
| PBMC rest | 0.0 | Lung fibroblast none | 0.0 |
| PBMC PWM | 11.7 | Lung fibroblast TNF alpha +IL-1beta | 0.0 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |

TABLE 76-continued

| Panel 4D | | | |
|---|---|---|---|
| Tissue Name | Rel. Exp. (%) Ag2907, Run 157284733 | Tissue Name | Rel. Exp. (%) Ag2907, Run 157284733 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 13.1 |
| Monocytes rest | 0.0 | IBD Crohn's | 6.9 |
| Monocytes LPS | 26.1 | Colon | 0.0 |
| Macrophages rest | 0.0 | Lung | 0.0 |
| Macrophages LPS | 0.0 | Thymus | 16.0 |
| HUVEC none | 0.0 | Kidney | 13.1 |
| HUVEC starved | 0.0 | | |

Panel 1.3D Summary: Ag2907 Results from two experiments with the same probe/primer set are in good agreement. Expression of the CG56097-01 gene is highest in a sample derived from pituitary tissue (CTs=31–33) with little to no expression detected in any other tissue. Thus, expression of this gene could be used to distinguish pituitary gland from the other samples on this panel.

The protein encoded for by this gene is most homologous to a glucuronosyltransferase that is normally found in liver. UDP glycosyltransferases (UGT) are a superfamily of enzymes that catalyze the addition of the glycosyl group from a UTP-sugar to a small hydrophobic molecule. Glucuronosyltransferases are membrane-bound microsomal enzymes that catalyze the transfer of glucuronic acid to a wide variety of exogenous and endogenous lipophilic substrates. These enzymes are of major importance in the detoxification and subsequent elimination of xenobiotics such as drugs and carcinogens. The pituitary plays a major role in the physiology of many different systems in the body. Therefore, the CG56097-01 gene may play an essential role in maintaining proper function of the pituitary gland and many of its secreted peptides. Furthermore, therapeutic modulation of the activity of this gene or its protein product using small molecule drugs may be useful for the treatment of diabetes and obesity as well as growth, reproductive, and endocrine disorders.

Panel 2.2 Summary: Ag2907 Expression of the CG56097-01 gene is low/undetectable (CTs>35) across all of the samples on this panel (data not shown).

Panel 2D Summary: Ag2907 Expression of the CG56097-01 gene is highest and almost exclusive to a sample derived from a prostate cancer (CT=31.7). Thus, the expression of this gene could be used to distinguish prostate cancer from the other samples in the panel. Moreover, therapeutic modulation of the activity of this gene or its protein product, through the use of small molecule drugs, protein therapeutics or antibodies, might be of benefit in the treatment of prostate cancer.

Panel 3D Summary: Ag2907 Expression of the CG56097-01 gene is highest in a sample derived from a squamous cell carcinoma cell line (CT=33.8). Thus, the expression of this gene could be used to distinguish this sample from the other samples in the panel.

Panel 4D Summary: Ag2907 Expression of the CG56097-01 gene is detected at a very low level in small airway epithelium treated with the inflammatory cytokines TNF-a and IL-1b (CT=34.2). Thus, expression of this gene may be a marker of loss of homeostasis in this cell type.

J. NOV14b: Prostasin Precursor

Expression of the NOV 14b gene (CG56123-02) was assessed using the primer-probe set Ag3360, described in Table 77.

TABLE 77

| Probe Name Ag3360 | | | | |
|---|---|---|---|---|
| Primers | Sequences | | Length | Start Position |
| Forward | 5'-gtacactctggcctccagctat-3' | (SEQ ID NO:238) | 22 | 1017 |
| Probe | TET-5'-ctcctggatccaaagcaaggactctg-3'-TAMRA | (SEQ ID NO:239) | 26 | 1041 |
| Reverse | 5'-gaatgggctcaaagatcaagat-3' | (SEQ ID NO:240) | 22 | 1084 |

CNS_neurodegeneration_v1.0 Summary: Ag3360 Expression of the CG56123-02 gene is low/undetectable (CTs>35) across all of the samples on this panel (data not shown).

General_screening_panel_v1.4 Summary: Ag3360 Expression of the CG56123-02 gene is low/undetectable (CTs>35) across all of the samples on this panel (data not shown).

Panel 4D Summary: Ag3360 Expression of the CG56123-02 gene is low/undetectable (CTs>35) across all of the samples on this panel (data not shown).

K. NOV15: LDLB-like

Expression of the NOV15 gene (CG50153-01) was assessed using the primer-probe sets Ag2452 and Ag2002, described in Tables 78–79. Results of the RTQ-PCR runs are shown in Tables 80–83. Please note that this gene was previously incorrectly called LDL receptor-like. However, this gene is most homologous to the mouse LDLB gene, encoding a cytosolic protein that is essential for normal Golgi function (Chatterton J E, Hirsch D, Schwartz J J, Bickel P E, Rosenberg R D, Lodish H F, Krieger M. Expression cloning of LDLB, a gene essential for normal Golgi function and assembly of the ldlCp complex. Proc Natl Acad Sci USA 1999 Feb. 2;96(3):915–20).

TABLE 78

| Primers | Sequences | | Length | Start Position |
|---|---|---|---|---|
| | Probe Name Ag2452 | | | |
| Forward | 5'-agcagtgcagttgtgaaagttt-3' | (SEQ ID NO:241) | 22 | 2053 |
| Probe | TET-5'-tgattcatggattcacccagtcatta-3'-TAMRA | (SEQ ID NO:242) | 26 | 2075 |
| Reverse | 5'-cagaactgagccagcatcat-3' | (SEQ ID NO:243) | 20 | 2108 |

TABLE 79

| Primers | Sequences | | Length | Start Position |
|---|---|---|---|---|
| | Probe Name Ag2002 | | | |
| Forward | 5'-gccagaaaggcaactattcag-3' | (SEQ ID NO:244) | 21 | 697 |
| Probe | TET-5'-aacttctcaaccagccacaccatggt-3'-TAMRA | (SEQ ID NO:245) | 26 | 719 |
| Reverse | 5'-agcaactccactaatgagcaaa-3' | (SEQ ID NO:246) | 22 | 764 |

TABLE 80

CNS_neurodegeneration_v1.0

| Tissue Name | Rel. Exp. (%) Ag2452, Run 206266095 | Tissue Name | Rel. Exp. (%) Ag2452, Run 206266095 |
|---|---|---|---|
| AD 1 Hippo | 8.0 | Control (Path) 3 Temporal Ctx | 4.2 |
| AD 2 Hippo | 36.3 | Control (Path) 4 Temporal Ctx | 35.6 |
| AD 3 Hippo | 2.9 | AD 1 Occipital Ctx | 5.2 |
| AD 4 Hippo | 8.3 | AD 2 Occipital Ctx (Missing) | 0.0 |
| AD 5 hippo | 52.1 | AD 3 Occipital Ctx | 2.1 |
| AD 6 Hippo | 47.0 | AD 4 Occipital Ctx | 27.9 |
| Control 2 Hippo | 37.4 | AD 5 Occipital Ctx | 15.7 |
| Control 4 Hippo | 7.7 | AD 6 Occipital Ctx | 49.3 |
| Control (Path) 3 Hippo | 3.6 | Control 1 Occipital Ctx | 2.1 |
| AD 1 Temporal Ctx | 7.9 | Control 2 Occipital Ctx | 65.1 |
| AD 2 Temporal Ctx | 49.0 | Control 3 Occipital Ctx | 10.0 |
| AD 3 Temporal Ctx | 4.1 | Control 4 Occipital Ctx | 5.2 |
| AD 4 Temporal Ctx | 28.3 | Control (Path) 1 Occipital Ctx | 87.1 |
| AD 5 Inf Temporal Ctx | 76.3 | Control (Path) 2 Occipital Ctx | 9.0 |
| AD 5 Sup Temporal Ctx | 32.8 | Control (Path) 3 Occipital Ctx | 1.5 |

TABLE 80-continued

CNS_neurodegeneration_v1.0

| Tissue Name | Rel. Exp. (%) Ag2452, Run 206266095 | Tissue Name | Rel. Exp. (%) Ag2452, Run 206266095 |
|---|---|---|---|
| AD 6 Inf Temporal Ctx | 46.7 | Control (Path) 4 Occipital Ctx | 11.9 |
| AD 6 Sup Temporal Ctx | 42.0 | Control 1 Parietal Ctx | 5.0 |
| Control 1 Temporal Ctx | 3.7 | Control 2 Parietal Ctx | 28.9 |
| Control 2 Temporal Ctx | 51.1 | Control 3 Parietal Ctx | 15.5 |
| Control 3 Temporal Ctx | 14.0 | Control (Path) 1 Parietal Ctx | 87.1 |
| Control 4 Temporal Ctx | 7.5 | Control (Path) 2 Parietal Ctx | 24.7 |
| Control (Path) 1 Temporal Ctx | 100.0 | Control (Path) 3 Parietal Ctx | 1.3 |
| Control (Path) 2 Temporal Ctx | 45.1 | Control (Path) 4 Parietal Ctx | 41.8 |

TABLE 81

Panel 1.3D

| Tissue Name | Rel. Exp.(%) Ag2002, Run 147805868 | Rel. Exp.(%) Ag2452, Run 155896645 | Tissue Name | Rd. Exp.(%) Ag2002, Run 147805868 | Rel. Exp.(%) Ag2452, Run 155896645 |
|---|---|---|---|---|---|
| Liver adenocarcinoma | 15.9 | 6.1 | Kidney (fetal) | 9.7 | 5.9 |
| Pancreas | 5.0 | 3.1 | Renal ca. 786-0 | 6.8 | 2.7 |

TABLE 81-continued

Panel 1.3D

| Tissue Name | Rel. Exp.(%) Ag2002, Run 147805868 | Rel. Exp.(%) Ag2452, Run 155896645 | Tissue Name | Rd. Exp.(%) Ag2002, Run 147805868 | Rel. Exp.(%) Ag2452, Run 155896645 |
|---|---|---|---|---|---|
| Pancreatic ca. CAPAN 2 | 3.8 | 1.7 | Renal ca. A498 | 34.9 | 14.8 |
| Adrenal gland | 12.7 | 7.7 | Renal ca. RXF 393 | 6.9 | 1.3 |
| Thyroid | 13.6 | 6.7 | Renal ca. ACHN | 24.5 | 1.4 |
| Salivary gland | 7.3 | 4.9 | Renal ca. UO-31 | 15.5 | 3.7 |
| Pituitary gland | 23.8 | 24.8 | Renal ca. TK-10 | 14.9 | 4.6 |
| Brain (fetal) | 8.5 | 8.9 | Liver | 2.8 | 2.9 |
| Brain (whole) | 33.9 | 18.9 | Liver (fetal) | 7.9 | 7.1 |
| Brain (amygdala) | 19.6 | 28.9 | Liver ca. (hepatoblast) HepG2 | 28.1 | 5.8 |
| Brain (cerebellum) | 8.5 | 9.1 | Lung | 7.5 | 11.7 |
| Brain (hippocampus) | 48.6 | 100.0 | Lung (fetal) | 14.6 | 7.6 |
| Brain (substantia nigra) | 5.3 | 4.3 | Lung ca. (small cell) LX-1 | 16.6 | 3.1 |
| Brain (thalamus) | 15.4 | 13.1 | Lung ca. (small cell) NCI-H69 | 36.9 | 14.7 |
| Cerebral Cortex | 100.0 | 41.2 | Lung ca. (s.cell var.) SHP-77 | 30.6 | 15.6 |
| Spinal cord | 8.5 | 5.3 | Lung ca. (large cell)NCI-H460 | 4.5 | 2.2 |
| glio/astro U87-MG | 14.4 | 5.3 | Lung ca. (non-sm. cell) A549 | 12.0 | 8.2 |
| glio/astro U-118-MG | 39.5 | 20.0 | Lung ca. (non-s.cell) NCI-H23 | 15.4 | 3.8 |
| astrocytoma SW1783 | 25.5 | 10.3 | Lung ca. (non-s.cell) HOP-62 | 21.8 | 5.1 |
| neuro*; met SK-N-AS | 36.9 | 34.6 | Lung ca. (non-s.cl) NCI-H522 | 18.3 | 5.5 |
| astrocytoma SF-539 | 12.0 | 3.8 | Lung ca. (squam.) SW 900 | 9.8 | 4.0 |
| astrocytoma SNB-75 | 33.7 | 6.7 | Lung ca. (squam.) NCI-H596 | 14.7 | 3.1 |
| glioma SNB-19 | 16.0 | 3.9 | Mammary gland | 27.5 | 11.2 |
| glioma U251 | 0.0 | 3.9 | Breast ca.* (pl.ef) MCF-7 | 23.7 | 7.3 |
| glioma SF-295 | 28.9 | 8.2 | Breast ca.* (pl.ef) MDA-MB-231 | 39.8 | 23.7 |
| Heart (fetal) | 55.1 | 9.6 | Breast ca.* (pl.ef) T47D | 37.1 | 8.4 |
| Heart | 7.2 | 2.7 | Breast ca. BT-549 | 16.4 | 11.0 |
| Skeletal muscle (fetal) | 84.1 | 24.8 | Breast ca. MDA-N | 20.6 | 8.7 |
| Skeletal muscle | 8.4 | 3.8 | Ovary | 52.5 | 17.6 |
| Bone marrow | 3.1 | 4.5 | Ovarian ca. OVCAR-3 | 19.9 | 4.9 |
| Thymus | 7.5 | 3.3 | Ovarian ca. OVCAR-4 | 3.3 | 0.9 |
| Spleen | 12.7 | 9.0 | Ovarian ca. OVCAR-5 | 32.5 | 7.0 |
| Lymph node | 12.9 | 4.1 | Ovarian ca. OVCAR-8 | 14.4 | 5.4 |
| Colorectal | 18.7 | 5.9 | Ovarian ca. IGROV-1 | 3.8 | 1.9 |
| Stomach | 17.7 | 5.2 | Ovarian ca.* (ascites) SK-OV-3 | 12.0 | 4.4 |
| Small intestine | 10.4 | 10.4 | Uterus | 14.2 | 7.6 |
| Colon ca. SW480 | 34.2 | 7.8 | Placenta | 13.2 | 7.9 |
| Colon ca.* SW620(SW480 met) | 17.1 | 6.0 | Prostate | 6.8 | 6.0 |
| Colon ca. HT29 | 10.2 | 3.8 | Prostate ca.* (bone met)PC-3 | 18.4 | 8.1 |
| Colon ca. HCT-116 | 9.2 | 5.8 | Testis | 19.6 | 10.6 |
| Colon ca. CaCo-2 | 22.2 | 5.4 | Melanoma Hs688(A).T | 28.9 | 3.7 |
| Colon ca. tissue(ODO3866) | 15.7 | 5.3 | Melanoma* (met) Hs688(B).T | 45.7 | 2.3 |

TABLE 81-continued

Panel 1.3D

| Tissue Name | Rel. Exp.(%) Ag2002, Run 147805868 | Rel. Exp.(%) Ag2452, Run 155896645 | Tissue Name | Rd. Exp.(%) Ag2002, Run 147805868 | Rel. Exp.(%) Ag2452, Run 155896645 |
|---|---|---|---|---|---|
| Colon ca. HCC-2998 | 14.9 | 10.7 | Melanoma UACC-62 | 3.3 | 1.1 |
| Gastric ca.* (liver met) NCI-N87 | 31.6 | 10.7 | Melanoma M14 | 3.5 | 1.2 |
| Bladder | 5.3 | 3.8 | Melanoma LOX IMVI | 6.7 | 9.1 |
| Trachea | 14.0 | 13.2 | Melanoma* (met) SK-MEL-5 | 13.7 | 12.9 |
| Kidney | 3.3 | 2.3 | Adipose | 4.6 | 2.6 |

TABLE 82

Panel 2D

| Tissue Name | Rel. Exp. (%) Ag2452, Run 155897997 | Tissue Name | Rel. Exp. (%) Ag2452, Run 155897997 |
|---|---|---|---|
| Normal Colon | 100.0 | Kidney Margin 8120608 | 24.5 |
| CC Well to Mod Diff (ODO3866) | 18.2 | Kidney Cancer 8120613 | 51.1 |
| CC Margin (ODO3866) | 19.1 | Kidney Margin 8120614 | 29.1 |
| CC Gr. 2 rectosigmoid (ODO3868) | 8.0 | Kidney Cancer 9010320 | 19.3 |
| CC Margin (ODO3868) | 6.0 | Kidney Margin 9010321 | 31.4 |
| CC Mod Diff (ODO3920) | 23.3 | Normal Uterus | 6.8 |
| CC Margin (ODO3920) | 24.0 | Uterus Cancer 064011 | 32.1 |
| CC Gr. 2 ascend colon (ODO3921) | 91.4 | Normal Thyroid | 29.9 |
| CC Margin (ODO3921) | 19.8 | Thyroid Cancer 064010 | 28.3 |
| CC from Partial Hepatectomy (ODO4309) Mets | 66.4 | Thyroid Cancer A302152 | 17.1 |
| Liver Margin (ODO4309) | 21.2 | Thyroid Margin A302153 | 29.9 |
| Colon mets to lung (OD04451-01) | 24.3 | Normal Breast | 25.7 |
| Lung Margin (OD04451-02) | 14.7 | Breast Cancer (OD04566) | 15.3 |
| Normal Prostate 6546-1 | 33.9 | Breast Cancer (OD04590-01) | 76.8 |
| Prostate Cancer (OD04410) | 38.7 | Breast Cancer Mets (OD04590-03) | 68.3 |
| Prostate Margin (OD04410) | 35.8 | Breast Cancer Metastasis (OD04655-05) | 77.9 |
| Prostate Cancer (OD04720-01) | 52.5 | Breast Cancer 064006 | 14.2 |
| Prostate Margin (OD04720-02) | 68.3 | Breast Cancer 1024 | 24.3 |
| Normal Lung 061010 | 35.8 | Breast Cancer 9100266 | 68.3 |
| Lung Met to Muscle (OD04286) | 28.3 | Breast Margin 9100265 | 31.6 |
| Muscle Margin (ODO4286) | 17.8 | Breast Cancer A209073 | 35.4 |
| Lung Malignant Cancer (OD03126) | 35.6 | Breast Margin A2090734 | 22.8 |
| Lung Margin (OD03126) | 45.1 | Normal Liver | 9.6 |

TABLE 82-continued

Panel 2D

| Tissue Name | Rel. Exp. (%) Ag2452, Run 155897997 | Tissue Name | Rel. Exp. (%) Ag2452, Run 155897997 |
|---|---|---|---|
| Lung Cancer (OD04404) | 17.9 | Liver Cancer 064003 | 9.3 |
| Lung Margin (OD04404) | 18.0 | Liver Cancer 1025 | 9.7 |
| Lung Cancer (OD04565) | 6.9 | Liver Cancer 1026 | 9.6 |
| Lung Margin (OD04565) | 8.2 | Liver Cancer 6004-T | 13.6 |
| Lung Cancer (OD04237-01) | 50.0 | Liver Tissue 6004-N | 18.8 |
| Lung Margin (OD04237-02) | 16.8 | Liver Cancer 6005-T | 10.3 |
| Ocular Mel Met to Liver (ODO4310) | 19.9 | Liver Tissue 6005-N | 1.7 |
| Liver Margin (ODO4310) | 18.6 | Normal Bladder | 53.2 |
| Melanoma Mets to Lung (OD04321) | 35.1 | Bladder Cancer 1023 | 37.1 |
| Lung Margin (OD04321) | 35.1 | Bladder Cancer A302173 | 26.6 |
| Normal Kidney | 57.4 | Bladder Cancer (OD04718-01) | 46.3 |
| Kidney Ca, Nuclear grade 2 (OD04338) | 58.2 | Bladder Normal Adjacent (OD04718-03) | 24.8 |
| Kidney Margin (OD04338) | 30.1 | Normal Ovary | 41.8 |
| Kidney Ca Nuclear grade ½ (OD04339) | 26.4 | Ovarian Cancer 064008 | 54.0 |
| Kidney Margin (OD04339) | 35.4 | Ovarian Cancer (OD04768-07) | 76.8 |
| Kidney Ca, Clear cell type (OD04340) | 38.7 | Ovary Margin (OD04768-08) | 10.5 |
| Kidney Margin (OD04340) | 28.7 | Normal Stomach | 33.0 |
| Kidney Ca, Nuclear grade 3 (OD04348) | 18.3 | Gastric Cancer 9060358 | 11.5 |
| Kidney Margin (OD04348) | 25.7 | Stomach Margin 9060359 | 28.5 |
| Kidney Cancer (OD04622-01) | 18.4 | Gastric Cancer 9060395 | 35.1 |
| Kidney Margin (OD04622-03) | 7.0 | Stomach Margin 9060394 | 40.3 |
| Kidney Cancer (OD04450-01) | 25.7 | Gastric Cancer 9060397 | 71.7 |

TABLE 82-continued

| Panel 2D | | | |
|---|---|---|---|
| Tissue Name | Rel. Exp. (%) Ag2452, Run 155897997 | Tissue Name | Rel. Exp. (%) Ag2452, Run 155897997 |
| Kidney Margin (OD04450-03) | 24.1 | Stomach Margin 9060396 | 18.2 |
| Kidney Cancer 8120607 | 13.2 | Gastric Cancer 064005 | 35.1 |

TABLE 83

Panel 4D

| Tissue Name | Rel. Exp.(%) Ag2002, Run 165826206 | Rel. Exp.(%) Ag2452, Run 155898869 | Tissue Name | Rel. Exp.(%) Ag2002, Run 165826206 | Rel. Exp.(%) Ag2452, Run 155898869 |
|---|---|---|---|---|---|
| Secondary Th1 act | 25.3 | 27.4 | HUVEC IL-1beta | 15.8 | 24.7 |
| Secondary Th2 act | 35.8 | 16.7 | HUVEC IFN gamma | 37.6 | 45.4 |
| Secondary Tr1 act | 36.9 | 46.3 | HUVEC TNF alpha + IFN gamma | 29.3 | 27.4 |
| Secondary Th1 rest | 25.9 | 13.4 | HUVEC TNF alpha + IL4 | 27.5 | 20.4 |
| Secondary Th2 rest | 18.9 | 17.8 | HUVEC IL-11 | 13.9 | 11.7 |
| Secondary Tr1 rest | 23.0 | 17.0 | Lung Microvascular EC none | 21.2 | 26.4 |
| Primary Th1 act | 15.9 | 31.0 | Lung Microvascular EC TNFalpha + IL-1beta | 29.1 | 34.9 |
| Primary Th2 act | 31.0 | 26.8 | Microvascular Dermal EC none | 25.5 | 36.3 |
| Primary Tr1 act | 30.4 | 35.8 | Microsvasular Dermal EC TNFalpha + IL-1beta | 25.7 | 28.7 |
| Primary Th1 rest | 76.8 | 83.5 | Bronchial epithelium TNFalpha + IL1beta | 23.0 | 6.3 |
| Primary Th2 rest | 33.9 | 39.2 | Small airway epithelium none | 18.8 | 17.7 |
| Primary Tr1 rest | 29.3 | 23.2 | Small airway epithelium TNFalpha + IL-1beta | 44.4 | 51.1 |
| CD45RA CD4 lymphocyte act | 26.1 | 30.1 | Coronery artery SMC rest | 27.9 | 45.4 |
| CD45RO CD4 lymphocyte act | 37.1 | 34.9 | Coronery artery SMC TNFalpha + IL-1beta | 22.4 | 25.0 |
| CD8 lymphocyte act | 21.9 | 16.8 | Astrocytes rest | 40.9 | 24.0 |
| Secondary CD8 lymphocyte rest | 26.8 | 24.3 | Astrocytes TNFalpha + IL-1beta | 58.6 | 17.4 |
| Secondary CD8 lymphocyte act | 23.2 | 28.9 | KU-812 (Basophil) rest | 28.5 | 31.0 |
| CD4 lymphocte none | 23.0 | 19.6 | KU-812 (Basophil) PMA/ionomycin | 63.7 | 65.1 |
| 2ry Th1/Th2/Tr1_anti-CD95 CH11 | 29.3 | 22.5 | CCD1106 (Keratinocytes) none | 17.1 | 18.9 |
| LAK cells rest | 17.0 | 21.5 | CCD1106 (Keratinocytes) TNFalpha + IL-1beta | 80.1 | 2.6 |
| LAK cells IL-2 | 33.2 | 22.8 | Liver cirrhosis | 16.7 | 3.3 |
| LAK cells IL-2 + IL-12 | 33.2 | 18.4 | Lupus kidney | 21.9 | 5.1 |
| LAK cells IL-2 + IFN gamma | 35.1 | 37.9 | NCI-H292 none | 24.0 | 46.3 |
| LAK cells IL-2 + IL-18 | 30.1 | 35.6 | NCI-H292 IL-4 | 24.3 | 42.6 |
| LAK cells PMA/ionomycin | 5.7 | 6.0 | NCI-H292 IL-9 | 25.2 | 58.6 |
| NK Cells IL-2 rest | 24.1 | 19.3 | NCI-H292 IL-13 | 11.7 | 32.3 |
| Two Way MLR 3 day | 29.3 | 28.9 | NCI-H292 IFN gamma | 14.8 | 37.9 |

TABLE 83-continued

| | Panel 4D | | | | |
|---|---|---|---|---|---|
| Tissue Name | Rel. Exp.(%) Ag2002, Run 165826206 | Rel. Exp.(%) Ag2452, Run 155898869 | Tissue Name | Rel. Exp.(%) Ag2002, Run 165826206 | Rel. Exp.(%) Ag2452, Run 155898869 |
| Two Way MLR 5 day | 22.4 | 15.3 | HPAEC none | 23.2 | 25.7 |
| Two Way MLR 7 day | 21.6 | 12.1 | HPAEC TNF alpha + IL-1 beta | 39.2 | 44.4 |
| PBMC rest | 14.7 | 12.4 | Lung fibroblast none | 40.6 | 26.2 |
| PBMC PWM | 22.4 | 57.8 | Lung fibroblast TNF alpha + IL-1 beta | 71.2 | 31.6 |
| PBMC PHA-L | 11.5 | 28.7 | Lung fibroblast IL-4 | 52.9 | 66.4 |
| Ramos (B cell) none | 27.2 | 21.5 | Lung fibroblast IL-9 | 29.9 | 67.8 |
| Ramos (B cell) ionomycin | 16.8 | 66.9 | Lung fibroblast IL-13 | 33.0 | 35.1 |
| B lymphocytes PWM | 23.7 | 65.5 | Lung fibroblast IFN gamma | 45.1 | 77.4 |
| B lymphocytes CD40L and IL-4 | 23.7 | 27.5 | Dermal fibroblast CCD1070 rest | 56.3 | 83.5 |
| EOL-1 dbcAMP | 8.8 | 6.0 | Dermal fibroblast CCD1070 TNF alpha | 84.7 | 100.0 |
| EOL-1 dbcAMP PMA/ionomycin | 8.3 | 6.6 | Dermal fibroblast CCD1070 IL-1 beta | 39.8 | 45.4 |
| Dendritic cells none | 14.0 | 10.1 | Dermal fibroblast IFN gamma | 15.5 | 19.5 |
| Dendritic cells LPS | 14.0 | 10.4 | Dermal fibroblast IL-4 | 29.3 | 42.3 |
| Dendritic cells anti-CD40 | 19.5 | 15.0 | IBD Colitis 2 | 4.8 | 2.2 |
| Monocytes rest | 25.3 | 22.5 | IBD Crohn's | 7.3 | 4.7 |
| Monocytes LPS | 25.3 | 20.0 | Colon | 100.0 | 37.9 |
| Macrophages rest | 21.6 | 24.8 | Lung | 15.1 | 26.6 |
| Macrophages LPS | 16.5 | 13.7 | Thymus | 40.1 | 55.1 |
| HUVEC none | 31.2 | 36.9 | Kidney | 35.4 | 67.8 |
| HUVEC starved | 45.4 | 55.9 | | | |

CNS_neurodegeneration_v1.0 Summary: Ag2452 The CG50153-01 gene is expressed in most of the samples in this panel with highest expression detected in the temporal cortex of a control patient (CT=29.4). This panel confirms the expression of the CG56071-01 gene in the CNS in an independent group of patients. However, no differential expression was found between Alzheimer's disease and control postmortem brains in this experiment. Please see Panel 1.3D for a discussion of the potential utility of this gene in the central nervous system.

Panel 1.3D Summary: Ag2002/Ag2452 Two experiments with two different probe/primer sets gave results that are in very good agreement, with highest expression in both runs occurring in regions of the brain. Expression of the CG50153-01 gene is highest in the cerebral cortex (CTs=26) in one run and the hippocampus in the other (CT=27), with significant expression also detected in the amygdala. This expression pattern indicates a potential role for the CG50153-01 gene product in Alzheimer's disease (AD), since this gene is expressed in the regions of the brain important to AD pathology. Therefore, the CG50153-01 gene product may be a promising antibody or small molecule target for the treatment of Alzheimer's disease.

High levels of expression of this gene are also detected in cell lines derived from brain cancer, breast cancer, lung cancer, kidney cancer and melanoma. In addition, the expression in normal ovary seems to be higher than in cell lines derived from ovarian cancer tissues. Thus, the expression of this gene could be of use as a marker or as a therapeutic for these cancers.

The CG50153-01 gene is widely expressed in tissues with metabolic and endocrine function, including adrenal gland, pituitary gland, thyroid, pancreas, adipose, liver, skeletal muscle and heart. Therefore, therapeutic modulation of the activity of this gene or its protein product using protein therapeutics, antibodies or small molecule drugs could be of benefit in the treatment of metabolic diseases such as obesity and diabetes, cardiovascular diseases and endocrine disorders. Significantly, this gene is expressed at higher levels in fetal skeletal muscle (CTs=27–30) than in adult skeletal muscle (CTs=30–33). This difference in expression suggests that the CG50153-01 protein product could be involved in muscular growth or development in the fetus and therefore could act in a regenerative capacity in an adult. Thus, therapeutic modulation of the CG50153-01 gene could be useful in the treatment of muscle related diseases and treatment with the protein product could restore muscle mass or function to weak or dystrophic muscle.

Panel 2D Summary: Ag2452 Highest expression of the CG50153-01 gene occurs in colon (CT=29.7). High levels of expression are also detectable in breast cancer, prostate cancer, ovarian cancer, and colon cancer when compared to their normal adjacent tissue. Thus, expression of the CG50153-01 gene could be used as a marker to detect the presence of these cancers. Moreover, therapeutic modulation of the activity of this gene or its protein product, using protein therapeutics, monoclonal antibodies, or small molecule drugs, could be of benefit in the treatment of breast, prostate, ovarian and colon cancer.

Panel 4D Summary: Ag2002/Ag2452 Two experiments with two different probe/primer sets show highest expression of the CG50153-01 gene in normal colon (CT=26.2) and dermal fibroblasts treated with TNF-alpha (CT=29.2). High expression of this gene in colon confirms the result obtained in Panel 2D. Significant expression is also seen in fibroblasts, endothelial and epithelial cells, keratinocytes, leukocytes, smooth muscle cells and normal kidney. The CG50153-01 gene is expressed at much lower levels in colon from a patient with inflammatory bowel disease (IBD) when compared to expression in normal colon. Similarly, expression in lupus kidney is much lower than normal kidney. Thus, the protein encoded by the CG50153-01 gene may be involved in normal tissue/cellular functions and at least in the kidney and colon and downregulation of this protein may serve as a diagnostic marker for lupus or IBD.

L. NOV16a and NOV16b: TRAF5-like

Expression of the NOV16a gene (CG56108-01) and the NOV16b gene (CG68108-02) was assessed using the primer-probe sets Ag3028 and Ag5257, described in Tables 84–85. Please note that Ag3028 recognizes both CG56108-01 and CG68108-02 variants, whereas Ag5257 specifically recognizes the CG68108-02 variant. Results of the RTQ-PCR runs are shown in Tables 86–90. In addition, please note that the CG56108-01 gene was previously incorrectly called TNF receptor-like; however, this gene is almost identical to the TRAF5 gene.

TABLE 84

Probe Name Ag3028

| Primers | Sequences | | Length | Start Position |
|---|---|---|---|---|
| Forward | 5'-aaaggacagtcttgctcagctt-3' | (SEQ ID NO:247) | 22 | 656 |
| Probe | TET-5'-caggacatacagccaggtgttcatct-3'-TAMRA | (SEQ ID NO:248) | 26 | 630 |
| Reverse | 5'-ccaacaattgtgcgaagattat-3' | (SEQ ID NO:249) | 22 | 593 |

TABLE 85

Probe Name Ag5257

| Primers | Sequences | | Length | Start Position |
|---|---|---|---|---|
| Forward | 5'-ggtagatgaacacctggctgtat-3' | (SEQ ID NO:250) | 23 | 627 |
| Probe | TET-5'-cctgaagctgagcaagactgtccttttaagcac-3'-TAMRA | (SEQ ID NO:251) | 33 | 652 |
| Reverse | 5'-taagtcagaaatcgttacagcaca-3' | (SEQ ID NO:252) | 24 | 691 |

TABLE 86

AI_comprehensive panel_v1.0

| Tissue Name | Rel. Exp.(%) Ag3028, Run 229313563 | Rel. Exp.(%) Ag5257, Run 229930786 | Tissue Name | Rel. Exp.(%) Ag3028, Run 229313563 | Rel. Exp.(%) Ag5257, Run 229930786 |
|---|---|---|---|---|---|
| 110967 COPD-F | 31.6 | 21.2 | 112427 Match Control Psoriasis-F | 42.9 | 59.5 |
| 1110980 COPD-F | 23.2 | 20.3 | 112418 Psoriasis-M | 23.2 | 34.6 |
| 110968 COPD-M | 45.7 | 30.8 | 112723 Match Control Psoriasis-M | 5.8 | 6.0 |
| 110977 COPD-M | 41.8 | 60.3 | 112419 Psoriasis-M | 42.9 | 36.9 |
| 110989 Emphysema-F | 62.4 | 65.1 | 112424 Match Control Psoriasis-M | 29.3 | 16.5 |
| 110992 Emphysema-F | 25.0 | 17.3 | 112420 Psoriasis-M | 100.0 | 73.2 |
| 110993 Emphysema-F | 40.3 | 37.4 | 112425 Match Control Psoriasis-M | 36.1 | 33.4 |
| 110994 Emphysema-F | 17.8 | 15.2 | 104689 (MF) OA Bone-Backus | 21.2 | 15.2 |
| 110995 Emphysema-F | 38.4 | 36.9 | 104690 (MF) Adj "Normal" Bone-Backus | 12.2 | 9.0 |
| 110996 Emphysema-F | 6.3 | 9.8 | 104691 (MF) OA Synovium-Backus | 30.1 | 31.4 |
| 110997 Asthma-M | 1.3 | 2.0 | 104692 (BA) OA Cartilage-Backus | 2.3 | 2.6 |
| 111001 Asthma-F | 35.6 | 30.6 | 104694 (BA) OA Bone-Backus | 19.9 | 16.4 |

TABLE 86-continued

| AI_comprehensive panel_v1.0 | | | | | |
|---|---|---|---|---|---|
| Tissue Name | Rel. Exp.(%) Ag3028, Run 229313563 | Rel. Exp.(%) Ag5257, Run 229930786 | Tissue Name | Rel. Exp.(%) Ag3028, Run 229313563 | Rel. Exp.(%) Ag5257, Run 229930786 |
| 111002 Asthma-F | 46.0 | 38.4 | 104695 (BA) Adj "Normal" Bone-Backus | 9.5 | 14.7 |
| 111003 Atopic Asthma-F | 37.4 | 37.6 | 104696 (BA) OA Synovium-Backus | 30.1 | 33.2 |
| 11004 Atopic Asthma-F | 39.0 | 37.9 | 104700 (SS) OA Bone-Backus | 9.0 | 14.3 |
| 111005 Atopic Asthma-F | 28.1 | 33.4 | 104701 (SS) Adj "Normal" Bone-Backus | 13.2 | 11.1 |
| 111006 Atopic Asthma F | 7.9 | 8.3 | 104702 (SS) OA Synovium-Backus | 33.2 | 21.2 |
| 111417 Allergy-M | 20.0 | 30.1 | 117093 OA Cartilage Rep7 | 46.3 | 39.5 |
| 112347 Allergy-M | 4.0 | 1.6 | 112672 OA Bone5 | 33.0 | 31.0 |
| 112349 Normal Lung-F | 2.9 | 1.6 | 112673 OA Synovium5 | 17.3 | 14.6 |
| 112357 Normal Lung-F | 13.9 | 18.4 | 112674 OA Synovial Fluid cells5 | 17.8 | 15.5 |
| 112354 Normal Lung-M | 7.1 | 13.8 | 117100 OA Cartilage Rep14 | 7.0 | 9.6 |
| 112374 Crohns-F | 18.7 | 29.7 | 112756 OA Bone9 | 49.7 | 47.0 |
| 112389 Match Control Crohns-F | 19.8 | 15.3 | 112757 OA Synovium9 | 1.8 | 3.3 |
| 112375 Crohns-F | 17.2 | 17.3 | 112758 OA Synovial Fluid Cells9 | 19.3 | 27.5 |
| 112732 Match Control Crohns-F | 37.1 | 47.0 | 1117125 RA Cartilage Rep2 | 34.6 | 36.6 |
| 112725 Crohns-M | 12.9 | 9.3 | 113492 Bone2 RA | 16.0 | 14.2 |
| 112387 Match Control Crohns-M | 13.3 | 18.2 | 113493 Synovium2 RA | 3.9 | 3.8 |
| 112378 Crohns-M | 3.4 | 1.3 | 113494 Syn Fluid Cells RA | 6.2 | 5.9 |
| 112390 Match Control Crohns-M | 48.0 | 59.5 | 113499 Cartilage4 RA | 5.7 | 9.0 |
| 112726 Crohns-M | 22.1 | 27.9 | 113500 Bone4 RA | 10.0 | 7.5 |
| 112731 Match Control Crohns-M | 15.7 | 24.5 | 113501 Synovium4 RA | 5.7 | 3.5 |
| 112380 Ulcer Col-F | 40.9 | 59.5 | 113502 Syn Fluid Cells4 RA | 4.0 | 6.8 |
| 112734 Match Control Ulcer Col-F | 80.1 | 50.7 | 113495 Cartilage3 RA | 5.2 | 6.0 |
| 112384 Ulcer Col-F | 89.5 | 100.0 | 113496 Bone3 RA | 5.3 | 5.9 |
| 112737 Match Control Ulcer Col-F | 7.9 | 15.0 | 1113497 Synovium3 RA | 3.2 | 5.3 |
| 112386 Ulcer Col-F | 10.6 | 28.5 | 113498 Syn Fluid Cells3 RA | 8.8 | 6.0 |
| 112738 Match Control Ulcer Col-F | 6.9 | 9.7 | 117106 Normal Cartilage Rep20 | 7.3 | 12.8 |
| 112381 Ulcer Col-M | 2.4 | 1.0 | 113663 Bone3 Normal | 9.5 | 19.9 |
| 112735 Match Control Ulcer Col-M | 41.8 | 17.6 | 113664 Synovium3 Normal | 1.3 | 0.0 |
| 112382 Ulcer Col-M | 32.3 | 27.2 | 113665 Syn Fluid Cells3 Normal | 3.9 | 1.2 |
| 112394 Match Control Ulcer Col-M | 7.9 | 4.2 | 117107 Normal Cartilage Rep22 | 10.0 | 7.4 |
| 112383 Ulcer Col-M | 40.1 | 54.3 | 113667 Bone4 Normal | 18.6 | 13.2 |
| 112736 Match Control Ulcer Col-M | 8.4 | 12.9 | 113668 Synovium4 Normal | 19.1 | 14.6 |

TABLE 86-continued

| AI_comprehensive panel_v1.0 | | | | | |
|---|---|---|---|---|---|
| Tissue Name | Rel. Exp.(%) Ag3028, Run 229313563 | Rel. Exp.(%) Ag5257, Run 229930786 | Tissue Name | Rel. Exp.(%) Ag3028, Run 229313563 | Rel. Exp.(%) Ag5257, Run 229930786 |
| 112423 Psoriasis-F | 40.9 | 35.1 | 113669 Syn Fluid Cells4 Normal | 29.7 | 16.7 |

TABLE 87

| General_screening_panel_v1.5 | | | |
|---|---|---|---|
| Tissue Name | Rel. Exp.(%) Ag5257, 229827564 | Tissue Name | Rel. Exp.(%) Ag5257, 229827564 |
| Adipose | 3.5 | Renal ca. TK-10 | 15.3 |
| Melanoma* Hs688(A).T | 19.5 | Bladder | 11.3 |
| Melanoma* Hs688(B).T | 14.5 | Gastric ca. (liver met.) NCI-N87 | 20.0 |
| Melanoma* M14 | 6.3 | Gastric ca. KATO III | 18.9 |
| Melanoma* LOXIMVI | 0.9 | Colon ca. SW-948 | 4.3 |
| Melanoma* SK-MEL-5 | 16.5 | Colon ca. SW480 | 5.1 |
| Squamous cell carcinoma SCC-4 | 1.9 | Colon ca.* (SW480 met) SW620 | 76.8 |
| Testis Pool | 5.2 | Colon ca. HT29 | 4.6 |
| Prostate ca.* (bone met) PC-3 | 6.1 | Colon ca. HCT-116 | 5.8 |
| Prostate Pool | 4.7 | Colon ca. CaCo-2 | 5.3 |
| Placenta | 0.6 | Colon cancer tissue | 6.8 |
| Uterus Pool | 3.0 | Colon ca. SW1116 | 1.7 |
| Ovarian ca. OVCAR-3 | 2.5 | Colon ca. Colo-205 | 10.3 |
| Ovarian ca. SK-OV-3 | 11.5 | Colon ca. SW-48 | 8.4 |
| Ovarian ca. OVCAR-4 | 0.4 | Colon Pool | 18.2 |
| Ovarian ca. OVCAR-5 | 8.1 | Small Intestine Pool | 6.1 |
| Ovarian ca. IGROV-1 | 3.3 | Stomach Pool | 5.4 |
| Ovarian ca. OVCAR-8 | 1.5 | Bone Marrow Pool | 2.9 |
| Ovary | 6.1 | Fetal Heart | 2.1 |
| Breast ca. MCF-7 | 8.7 | Heart Pool | 5.1 |
| Breast ca. MDA-MB-231 | 10.7 | Lymph Node Pool | 21.0 |
| Breast ca. BT 549 | 5.4 | Fetal Skeletal Muscle | 2.4 |
| Breast ca. T47D | 1.9 | Skeletal Muscle Pool | 2.1 |
| Breast ca. MDA-N | 3.4 | Spleen Pool | 9.5 |
| Breast Pool | 17.4 | Thymus Pool | 12.4 |
| Trachea | 6.0 | CNS cancer (glio/astro) U87-MG | 2.4 |
| Lung | 1.2 | CNS cancer (glio/astro) U-118-MG | 8.7 |
| Fetal Lung | 15.5 | CNS cancer (neuro;met) SK-N-AS | 17.9 |
| Lung ca. NCI-N417 | 0.3 | CNS cancer (astro) SF-539 | 3.1 |
| Lung ca. LX-1 | 100.0 | CNS cancer (astro) SNB-75 | 3.3 |
| Lung ca. NCI-H146 | 6.4 | CNS cancer (glio) SNB-19 | 35.4 |
| Lung ca. SHP-77 | 3.7 | CNS cancer (glio) SF-295 | 6.1 |
| Lung ca. A549 | 6.6 | Brain (Amygdala) Pool | 1.3 |
| Lung ca. NCI-H526 | 1.7 | Brain (cerebellum) | 2.9 |
| Lung ca. NCI-H23 | 7.9 | Brain (fetal) | 5.0 |
| Lung ca. NCI-H460 | 44.1 | Brain (Hippocampus) Pool | 2.6 |
| Lung ca. HOP-62 | 3.0 | Cerebral Cortex Pool | 2.3 |
| Lung ca. NCI-H522 | 7.5 | Brain (Substantia nigra) Pool | 1.1 |
| Liver | 0.0 | Brain (Thalamus) Pool | 2.8 |
| Fetal Liver | 1.4 | Brain (whole) | 3.6 |
| Liver ca. HepG2 | 0.4 | Spinal Cord Pool | 1.9 |
| Kidney Pool | 21.3 | Adrenal Gland | 1.9 |
| Fetal Kidney | 6.6 | Pituitary gland Pool | 1.3 |
| Renal ca. 786-0 | 1.1 | Salivary Gland | 2.9 |
| Renal ca. A498 | 2.0 | Thyroid (female) | 0.4 |
| Renal ca. ACHN | 4.8 | Pancreatic ca. CAPAN2 | 3.8 |
| Renal ca. UO-31 | 5.5 | Pancreas Pool | 17.6 |

TABLE 88

Panel 1.3D

| Tissue Name | Rel. Exp.(%) Ag3028, Run 167968641 | Tissue Name | Rel. Exp.(%) Ag3028, Run 167968641 |
|---|---|---|---|
| Liver adenocarcinoma | 2.2 | Kidney (fetal) | 6.2 |
| Pancreas | 3.4 | Renal ca. 786-0 | 0.7 |
| Pancreatic ca. CAPAN 2 | 1.4 | Renal ca. A498 | 1.1 |
| Adrenal gland | 0.6 | Renal ca. RXF 393 | 6.5 |
| Thyroid | 0.6 | Renal ca. ACHN | 2.9 |
| Salivary gland | 2.2 | Renal ca. UO-31 | 1.0 |
| Pituitary gland | 0.4 | Renal ca. TK-10 | 12.3 |
| Brain (fetal) | 3.5 | Liver | 0.5 |
| Brain (whole) | 2.5 | Liver (fetal) | 0.5 |
| Brain (amygdala) | 1.9 | Liver ca. (hepatoblast) HepG2 | 0.3 |
| Brain (cerebellum) | 0.6 | Lung | 1.3 |
| Brain (hippocampus) | 1.6 | Lung (fetal) | 3.5 |
| Brain (substantia nigra) | 0.7 | Lung ca. (small cell) LX-1 | 47.0 |
| Brain (thalamus) | 1.6 | Lung ca. (small cell) NCI-H69 | 18.6 |
| Cerebral Cortex | 0.8 | Lung ca. (s.cell var.) SHP-77 | 14.1 |
| Spinal cord | 1.1 | Lung ca. (large cell)NCI-H460 | 0.7 |
| glio/astro U87-MG | 1.2 | Lung ca. (non-sm. cell) A549 | 8.1 |
| glio/astro U-118-MG | 4.3 | Lung ca. (non-s.cell) NCI-H23 | 2.4 |
| astrocytoma SW1783 | 2.5 | Lung ca. (non-s.cell) HOP-62 | 4.8 |
| neuro*; met SK-N-AS | 7.5 | Lung ca. (non-s.cl) NCI-H522 | 4.0 |
| astrocytoma SF-539 | 2.0 | Lung ca. (squam.) SW 900 | 4.9 |
| astrocytoma SNB-75 | 3.5 | Lung ca. (squam.) NCI-H596 | 16.0 |
| glioma SNB-19 | 1.6 | Mammary gland | 3.1 |
| glioma U251 | 9.4 | Breast ca.* (pl.ef) MCF-7 | 4.2 |
| glioma SF-295 | 2.2 | Breast ca.* (pl.ef) MDA-MB-231 | 4.3 |
| Heart (fetal) | 0.8 | Breast ca.* (pl.ef) T47D | 11.1 |
| Heart | 0.8 | Breast ca. BT-549 | 1.0 |
| Skeletal muscle (fetal) | 1.4 | Breast ca. MDA-N | 3.3 |
| Skeletal muscle | 0.8 | Ovary | 0.9 |
| Bone marrow | 0.5 | Ovarian ca. OVCAR-3 | 1.6 |
| Thymus | 7.9 | Ovarian ca. OVCAR-4 | 0.2 |
| Spleen | 3.8 | Ovarian ca. OVCAR-5 | 9.2 |
| Lymph node | 10.2 | Ovarian ca. OVCAR-8 | 0.4 |
| Colorectal | 3.9 | Ovarian ca. IGROV-1 | 3.3 |
| Stomach | 1.9 | Ovarian ca.* (ascites) SK-OV-3 | 18.4 |
| Small intestine | 1.2 | Uterus | 5.6 |
| Colon ca. SW480 | 1.3 | Placenta | 0.1 |
| Colon ca.* SW620(SW480 met) | 100.0 | Prostate | 0.6 |
| Colon ca. HT29 | 4.5 | Prostate ca.* (bone met)PC-3 | 2.6 |
| Colon ca. HCT-116 | 2.0 | Testis | 0.9 |
| Colon ca. CaCo-2 | 1.5 | Melanoma Hs688(A).T | 4.4 |
| Colon ca. tissue(ODO3866) | 6.3 | Melanoma* (met) Hs688(B).T | 5.0 |
| Colon ca. HCC-2998 | 7.9 | Melanoma UACC-62 | 2.5 |
| Gastric ca.* (liver met) NCI-N87 | 6.2 | Melanoma M14 | 2.3 |

TABLE 88-continued

Panel 1.3D

| Tissue Name | Rel. Exp.(%) Ag3028, Run 167968641 | Tissue Name | Rel. Exp.(%) Ag3028, Run 167968641 |
|---|---|---|---|
| Bladder | 7.9 | Melanoma LOX IMVI | 0.4 |
| Trachea | 2.1 | Melanoma* (met) SK-MEL-5 | 6.5 |
| Kidney | 1.6 | Adipose | 6.9 |

TABLE 89

Panel 4.1D

| Tissue Name | Rel. Exp.(%) Ag5257, Run 229851532 | Tissue Name | Rel. Exp.(%) Ag5257, Run 229851532 |
|---|---|---|---|
| Secondary Th1 act | 80.7 | HUVEC IL-1 beta | 10.7 |
| Secondary Th2 act | 81.8 | HUVEC IFN gamma | 18.8 |
| Secondary Tr1 act | 66.4 | HUVEC TNF alpha + IFN gamma | 5.8 |
| Secondary Th1 rest | 12.2 | HUVEC TNF alpha + IL4 | 7.8 |
| Secondary Th2 rest | 17.4 | HUVEC IL-11 | 7.3 |
| Secondary Tr1 rest | 15.4 | Lung Microvascular EC none | 20.0 |
| Primary Th1 act | 3.0 | Lung Microvascular EC TNF alpha + IL-1 beta | 14.4 |
| Primary Th2 act | 51.8 | Microvascular Dermal EC none | 5.1 |
| Primary Tr1 act | 34.9 | Microsvasular Dermal EC TNF alpha + IL-1 beta | 8.5 |
| Primary Th1 rest | 2.3 | Bronchial epithelium TNF alpha + IL1 beta | 0.0 |
| Primary Th2 rest | 11.3 | Small airway epithelium none | 0.0 |
| Primary Tr1 rest | 9.7 | Small airway epithelium TNF alpha + IL-1 beta | 0.0 |
| CD45RA CD4 lymphocyte act | 25.3 | Coronery artery SMC rest | 10.7 |
| CD45RO CD4 lymphocyte act | 66.0 | Coronery artery SMC TNF alpha + IL-1 beta | 7.2 |
| CD8 lymphocyte act | 27.2 | Astrocytes rest | 15.6 |
| Secondary CD8 lymphocyte rest | 31.0 | Astrocytes TNF alpha + IL-1 beta | 8.5 |
| Secondary CD8 lymphocyte act | 12.9 | KU-812 (Basophil) rest | 58.6 |
| CD4 lymphocyte none | 9.9 | KU-812 (Basophil) PMA/ionomycin | 70.7 |
| 2ry Th1/Th2/Tr1_anti-CD95 CH11 | 9.6 | CCD1106 (Keratinocytes) none | 6.8 |
| LAK cells rest | 15.9 | CCD1106 (Keratinocytes) TNF alpha + IL-1 beta | 2.1 |
| LAK cells IL-2 | 29.3 | Liver cirrhosis | 7.4 |
| LAK cells IL-2 + IL-12 | 21.2 | NCI-H292 none | 4.4 |
| LAK cells IL-2 + IFN gamma | 12.2 | NCI-H292 IL-4 | 10.2 |
| LAK cells IL-2 + IL-18 | 20.2 | NCI-H292 IL-9 | 5.2 |
| LAK cells PMA/ionomycin | 27.2 | NCI-H292 IL-13 | 7.3 |
| NK Cells IL-2 rest | 90.8 | NCI-H292 IFN gamma | 10.0 |
| Two Way MLR 3 day | 25.7 | HPAEC none | 9.0 |
| Two Way MLR 5 day | 9.4 | HPAEC TNF alpha + IL-1 beta | 19.8 |
| Two Way MLR 7 day | 10.2 | Lung fibroblast none | 15.1 |
| PBMC rest | 7.2 | Lung fibroblast TNF alpha + IL-1 beta | 11.0 |
| PBMC PWM | 12.4 | Lung fibroblast IL-4 | 10.9 |
| PBMC PHA-L | 19.6 | Lung fibroblast IL-9 | 14.9 |
| Ramos (B cell) none | 29.7 | Lung fibroblast IL-13 | 7.1 |
| Ramos (B cell) ionomycin | 40.9 | Lung fibroblast IFN gamma | 28.9 |
| B lymphocytes PWM | 29.5 | Dermal fibroblast CCD1070 rest | 17.8 |
| B lymphocytes CD40L and IL-4 | 68.3 | Dermal fibroblast CCD1070 TNF alpha | 100.0 |

TABLE 89-continued

Panel 4.1D

| Tissue Name | Rel. Exp.(%) Ag5257, Run 229851532 | Tissue Name | Rel. Exp.(%) Ag5257, Run 229851532 |
|---|---|---|---|
| EOL-1 dbcAMP | 0.0 | Dermal fibroblast CCD1070 IL-1 beta | 12.8 |
| EOL-1 dbcAMP PMA/ionomycin | 0.0 | Dermal fibroblast IFN gamma | 8.4 |
| Dendritic cells none | 33.7 | Dermal fibroblast IL-4 | 19.1 |
| Dendritic cells LPS | 27.2 | Dermal Fibroblasts rest | 7.8 |
| Dendritic cells anti-CD40 | 16.5 | Neutrophils TNFa + LPS | 0.0 |
| Monocytes rest | 0.0 | Neutrophils rest | 3.3 |
| Monocytes LPS | 5.5 | Colon | 0.0 |
| Macrophages rest | 3.1 | Lung | 0.0 |
| Macrophages LPS | 0.0 | Thymus | 14.1 |
| HUVEC none | 7.1 | Kidney | 9.5 |
| HUVEC starved | 8.8 | | |

TABLE 90

Panel 4D

| Tissue Name | Rel. Exp.(%) Ag3028, Run 164528168 | Tissue Name | Rel. Exp.(%) Ag3028, Run 164528168 |
|---|---|---|---|
| Secondary Th1 act | 28.7 | HUVEC IL-1 beta | 3.0 |
| Secondary Th2 act | 26.4 | HUVEC IFN gamma | 8.8 |
| Secondary Tr1 act | 30.6 | HUVEC TNF alpha + IFN gamma | 8.0 |
| Secondary Th1 rest | 12.6 | HUVEC TNF alpha + IL4 | 6.6 |
| Secondary Th2 rest | 23.7 | HUVEC IL-11 | 4.4 |
| Secondary Tr1 rest | 21.9 | Lung Microvascular EC none | 4.3 |
| Primary Th1 act | 12.3 | Lung Microvascular EC TNF alpha + IL-1 beta | 7.8 |
| Primary Th2 act | 26.4 | Microvascular Dermal EC none | 7.6 |
| Primary Tr1 act | 28.9 | Microsvascular Dermal EC TNF alpha + IL-1 beta | 9.7 |
| Primary Th1 rest | 82.4 | Bronchial epithelium TNF alpha + IL1 beta | 3.4 |
| Primary Th2 rest | 55.1 | Small airway epithelium none | 0.8 |
| Primary Tr1 rest | 49.7 | Small airway epithelium TNF alpha + IL-1 beta | 2.6 |
| CD45RA CD4 lymphocyte act | 12.3 | Coronery artery SMC rest | 5.8 |
| CD45RO CD4 lymphocyte act | 31.0 | Coronery artery SMC TNF alpha + IL-1 beta | 2.8 |
| CD8 lymphocyte act | 20.6 | Astrocytes rest | 10.9 |
| Secondary CD8 lymphocyte rest | 24.7 | Astrocytes TNF alpha + IL-1 beta | 6.2 |
| Secondary CD8 lymphocyte act | 29.5 | KU-812 (Basophil) rest | 23.2 |
| CD4 lymphocyte none | 13.0 | KU-812 (Basophil) PMA/ionomycin | 55.9 |
| 2ry Th1/Th2/Tr1_anti CD95 CH11 | 32.1 | CCD1106 (Keratinocytes) none | 2.6 |
| LAK cells rest | 25.5 | CCD1106 (Keratinocytes) TNF alpha + IL-1 beta | 1.4 |
| LAK cells IL-2 | 33.9 | Liver cirrhosis | 1.7 |
| LAK cells IL-2 + IL-12 | 27.2 | Lupus kidney | 1.8 |
| LAK cells IL-2 + IFN gamma | 52.5 | NCI-H292 none | 3.6 |
| LAK cells IL-2 + IL-18 | 43.8 | NCI-H292 IL-4 | 5.8 |
| LAK cells PMA/ionomycin | 6.7 | NCI-H292 IL-9 | 4.8 |
| NK Cells IL-2 rest | 24.5 | NCI-H292 IL-13 | 2.9 |
| Two Way MLR 3 day | 17.0 | NCI-H292 IFN gamma | 4.2 |
| Two Way MLR 5 day | 9.2 | HPAEC none | 4.9 |
| Two Way MLR 7 day | 24.3 | HPAEC TNF alpha + IL-1 beta | 6.6 |
| PBMC rest | 8.9 | Lung fibroblast none | 5.3 |

TABLE 90-continued

Panel 4D

| Tissue Name | Rel. Exp.(%) Ag3028, Run 164528168 | Tissue Name | Rel. Exp.(%) Ag3028, Run 164528168 |
|---|---|---|---|
| PBMC PWM | 62.4 | Lung fibroblast TNF alpha + IL-1 beta | 3.7 |
| PBMC PHA-L | 31.9 | Lung fibroblast IL-4 | 14.6 |
| Ramos (B cell) none | 24.3 | Lung fibroblast IL-9 | 10.4 |
| Ramos (B cell) ionomycin | 100.0 | Lung fibroblast IL-13 | 11.4 |
| B lymphocytes PWM | 97.9 | Lung fibroblast IFN gamma | 18.4 |
| B lymphocytes CD40L and IL-4 | 74.7 | Dermal fibroblast CCD1070 rest | 18.9 |
| EOL-1 dbcAMP | 0.0 | Dermal fibroblast CCD1070 TNF alpha | 63.7 |
| EOL-1 dbcAMP PMA/ionomycin | 0.0 | Dermal fibroblast CCD1070 IL-1 beta | 6.0 |
| Dendritic cells none | 12.7 | Dermal fibroblast IFN gamma | 4.7 |
| Dendritic cells LPS | 19.8 | Dermal fibroblast IL-4 | 12.7 |
| Dendritic cells anti-CD40 | 16.0 | IBD Colitis 2 | 4.6 |
| Monocytes rest | 1.6 | IBD Crohn's | 2.0 |
| Monocytes LPS | 1.4 | Colon | 14.2 |
| Macrophages rest | 6.7 | Lung | 6.6 |
| Macrophages LPS | 3.0 | Thymus | 7.0 |
| HUVEC none | 4.3 | Kidney | 41.8 |
| HUVEC starved | 10.2 | | |

AI_comprehensive panel_v1.0 Summary: Ag3028 This experiment was performed using a probe/primer set that recognizes both the CG56108-01 and CG56108-02 variants. This gene is expressed at low to moderate levels in most of the tissues on this panel. However, gene expression is up-regulated in the skin of ¾ psoriasis patients and ⅘ colon form patients suffering from ulcerative colitis. In addition, bone and cartilage from osteoarthritis (OA) patients seems to have increased expression of this gene. Therefore, modulation of the expression or activity of this gene or its protein product by small peptides could be beneficial for the treatment of the condition or symptoms associated with psoriasis, OA and ulcerative colitis.

Ag5257 The expression of this gene was assessed in an independent experiment with a different probe/primer set that specifically recognizes the CG56108-02 variant. The results from this experiment were similar to what was observed with Ag3028.

General_screening_panel_v1.5 Summary: Ag5257 Expression of the CG56108-02 variant is highest in a sample derived from lung cancer cell line LX-1 (CT=30). In addition, there is substantial expression of this gene seen in a sample derived from a metastatic colon cancer cell line (SW620), as was seen using probe/primer set Ag3028. This is in contrast to the low level of expression in a genetically related cell line (SW480) that was derived from the primary tumor in the same patient. Thus, expression of this gene could be used to distinguish the sample derived from LX-1 cells from other samples in the panel, and also distinguish the sample derived from SW620 cells from SW480 cells. Moreover, therapeutic modulation of the activity of this gene or its protein product, through the use of small molecule drugs, antibodies or protein therapeutics, might be of benefit in the treatment of metastatic colon cancer or lung cancer.

The CG56108-02 gene encodes a variant of the TRAF5 gene. Tumor necrosis factor (TNF) receptor-associated factors (TRAFs) are signal transducers for members of the TNF receptor superfamily. TRAF proteins are composed of an N-terminal cysteine/histidine-rich region containing zinc RING and/or zinc finger motifs, a coiled coil (leucine zipper) motif, and a homologous region in the C terminus that defines the TRAF family, the TRAF domain. The TRAF domain is involved in self-association and receptor binding. Among tissues with metabolic or endocrine function, expression of this TRAF5 variant is limited to pancreas, indicating a potential role in insulin production and secretion. Therefore, therapeutic modulation of the activity of this gene may aid in the treatment of type II diabetes.

Panel 1.3D Summary: Ag3028 Expression of this gene is highest in a sample derived from metastatic colon cancer cell line SW620 (CT=26). This is in contrast to the low level of expression in genetically related cell line SW480 that was derived from the primary tumor in the same patient (CT=33). There is also substantial expression of this gene in a number of lung cancer cell lines. Thus, the expression of this gene could be used to distinguish the sample derived from SW620 cells from other samples in the panel, and in particular, the sample derived from SW480 cells. Moreover, therepeutic modulation of the activity of this gene or its protein product, through the use of small molecule drugs, antibodies or protein therapeutics, might be of benefit in the treatment of metastatic colon cancer.

This gene is also expressed at low levels throughout the central nervous system, including in amygdala, hippocampus, cerebellum, substantia nigra, thalamus, cerebral cortex, and spinal cord (CTs=32.8–34.5). Thus, this gene may play a general role in central nervous system function.

In addition, this gene is expressed at low levels in a number of tissues with metabolic or endocrine function including adrenal gland, thyroid, heart, skeletal muscle and liver and at higher levels in pancreas and adipose. Therefore, modulation of the activity of this gene or its protein product using small molecule drugs, antibodies or protein therapeutics might be of benefit in the treatment of metabolic diseases such as diabetes and obesity.

Panel 4.1D Summary: Ag5257 Expression of the CG56108-02 gene was assessed in an independent experiment using a probe/primer set specific for this variant. The expression profile of this gene across panel 4.1D is generally similar to what was observed in Panel 4D except that the level of expression is lower. However, some slight differences in expression are seen: highest expression of this gene is observed in dermal fibroblasts treated with TNF-a and IL-1, in NK cells and the basophil cell line KU-812. Therefore, modulation of the activity of this gene or its protein product by small molecule drugs could block inflammatory processes associated with basophil activity and skin injury, such as those observed in allergic diseases, asthma, inflammatory bowel disease, and psoriasis.

Panel 4D Summary: Ag3028 This gene is expressed at low to moderate levels in the majority of samples on Panel 4D. However, expression of this gene is highest in activated B cells (Ramos cell line treated with ionomycin), activated B lymphocytes (PWM treated) and B cells treated with CD40L and IL-4 (CTs=28). This gene is also expressed at significant levels in activated T cells, LAK cells and kidney.

This gene encodes for a protein that appears to be a variant of TRAF5, a signal transducer for the TNFR family which eventually leads to the activation of NF-kB. It has been reported that Traf5−/−B lymphocytes show defects in proliferation and upregulation of various surface molecules, including CD23, CD54, CD80, CD86 and FAS in response to CD40 stimulation (ref. 1). Moreover, in vitro Ig production by Traf5−/−T lymphocytes stimulated with anti-CD40 plus IL4 was reduced substantially.

Thus, modulation of the expression or activity of this gene or its protein product using small peptides could be beneficial for the treatment of B cell lymphoproliferative diseases or diseases associated with hyperglobulinemia, such as those observed in autoimmune diseases including systemic lupus erythematosus and rheumatoid arthritis. Furthermore, B cells signalling through CD40 in the presence of IL-4 can lead to immunoglobulin class switch to IgE and IgE can lead to severe allergic disorders. Therefore, modulation of the activity of this gene or its protein product using small molecule drugs, antibodies, or protein therapeutics, could be beneficial for the treatment of allergic diseases. Finally, the presence of this transcript in activated T cells suggest that therapeutics designed against this molecule could be beneficial for the treatment of T cell mediated diseases, including inflammatory bowel disease (IBD), psoriasis, and rheumatoid arthritis (Nakano H, Oshima H, Chung W, Williams-Abbott L, Ware CF, Yagita H, Okumura K. TRAF5, an activator of NF-kappaB and putative signal transducer for the lymphotoxin-beta receptor. J Biol Chem 1996 Jun. 21;271(25):14661–4).

M. NOV17: Ferritin Light Chain

Expression of the NOV17 gene (CG56101-01) was assessed using the primer-probe set Ag2912, described in Table 91. Results of the RTQ-PCR run is shown in Table 92.

TABLE 91

Probe Name Ag2912

| Primers | Sequences | | Length | Start Position |
|---|---|---|---|---|
| Forward | 5'-aattactgcaccgaagtggaa-3' | (SEQ ID NO:253) | 21 | 39 |
| Probe | TET-5'-ctgcgggcttcccttacctacctct-3'-TAMRA | (SEQ ID NO:254) | 25 | 90 |
| Reverse | 5'-cggtagaaatggaggatgaga-3' | (SEQ ID NO:255) | 21 | 116 |

TABLE 92

Panel 1.3D

| Tissue Name | Rel. Exp.(%) Ag2912, Run 161409374 | Tissue Name | Rel. Exp.(%) Ag2912, Run 161409374 |
|---|---|---|---|
| Liver adenocarcinoma | 0.0 | Kidney (fetal) | 0.0 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.0 | Renal ca. TK-10 | 0.0 |
| Brain (fetal) | 0.0 | Liver | 0.0 |
| Brain (whole) | 0.0 | Liver (fetal) | 0.0 |
| Brain (amygdala) | 0.0 | Liver ca. (hepatoblast) HepG2 | 0.0 |
| Brain (cerebellum) | 0.0 | Lung | 0.0 |
| Brain (hippocampus) | 0.0 | Lung (fetal) | 0.0 |
| Brain (substantia nigra) | 0.0 | Lung ca. (small cell) LX-1 | 0.0 |
| Brain (thalamus) | 0.0 | Lung ca. (small cell) NCI-H69 | 0.0 |
| Cerebral Cortex | 0.0 | Lung ca. (s.cell var.) SHP-77 | 0.0 |
| Spinal cord | 0.0 | Lung ca. (large cell) NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |

TABLE 92-continued

| Panel 1.3D | | | |
|---|---|---|---|
| Tissue Name | Rel. Exp.(%) Ag2912, Run 161409374 | Tissue Name | Rel. Exp.(%) Ag2912, Run 161409374 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 0.0 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (fetal) | 0.0 | Breast ca.* (pl.ef) T47D | 0.0 |
| Heart | 0.0 | Breast ca. BT-549 | 0.0 |
| Skeletal muscle (fetal) | 0.0 | Breast ca. MDA-N | 0.0 |
| Skeletal muscle | 0.0 | Ovary | 0.0 |
| Bone marrow | 0.0 | Ovarian ca. OVCAR-3 | 0.0 |
| Thymus | 0.0 | Ovarian ca. OVCAR-4 | 0.0 |
| Spleen | 0.0 | Ovarian ca. OVCAR-5 | 0.0 |
| Lymph node | 0.0 | Ovarian ca. OVCAR-8 | 25.3 |
| Colorectal | 7.5 | Ovarian ca. IGROV-1 | 0.0 |
| Stomach | 0.0 | Ovarian ca.* (ascites) SK-OV-3 | 0.0 |
| Small intestine | 0.0 | Uterus | 0.0 |
| Colon ca. SW480 | 0.0 | Placenta | 0.0 |
| Colon ca.* SW620(SW480 met) | 0.0 | Prostate | 0.0 |
| Colon ca. HT29 | 0.0 | Prostate ca.* (bone met)PC-3 | 0.0 |
| Colon ca. HCT-116 | 0.0 | Testis | 100.0 |
| Colon ca. CaCo-2 | 0.0 | Melanoma Hs688(A).T | 0.0 |
| Colon ca. tissue(ODO3866) | 0.0 | Melanoma* (met) Hs688(B).T | 0.0 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 0.0 | Melanoma LOX IMVI | 0.0 |
| Trachea | 0.0 | Melanoma* (met) SK-MEL-5 | 0.0 |
| Kidney | 0.0 | Adipose | 0.0 |

Panel 1.3D Summary: Ag2912 Low but significant expression of the CG56101-01 gene is limited to testis (CT=34.8). Therefore, expression of this gene could be used to distinguish testis from the other samples on this panel. Furthermore, therapeutic modulation of this gene or its protein product may be of benefit in the treatment of infertility.

Panel 2D Summary: Ag2912 Run 161410554 Expression of this gene is low/undetectable (CTs>35) across all of the samples on this panel (data not shown). Run 162354475 Results from one experiment with the CG56101-01 gene are not included. The amp plot indicates that there were experimental difficulties with this run.

Panel 4D Summary: Ag2912 Run 159354038 Results from one experiment with the CG56101-01 gene are not included. The amp plot indicates that there were experimental difficulties with this run.

N. NOV18: Neurotrophin-like Gene

Expression of the NOV18 gene (CG56095-01) was assessed using the primer-probe set ag3671, described in Table 93.

TABLE 93

| Probe Name Ag3671 | | | | |
|---|---|---|---|---|
| Primers | Sequences | | Length | Start Position |
| Forward | 5'-cctctccagtgtgtcaatgg-3' | (SEQ ID NO:256) | 20 | 253 |
| Probe | TET-5'-gtcctaaccccaccctcgacattgt-3'-TAMRA | (SEQ ID NO:257) | 25 | 274 |
| Reverse | 5'-aaggtcccactttggatcag-3' | (SEQ ID NO:258) | 20 | 308 |

General_screening_panel_v1.4 Summary: Ag3671 Expression of the CG56095-01 gene is low/undetectable (CTs>35) across all of the samples on this panel (data not shown).

P. NOV19a–NOV19c: Methionyl Aminopeptidase

Expression of the NOV19a–NOV19c genes (CG50287-02, CG50287-01, and CG50287-03) was assessed using the primer-probe sets Ag2541 and Ag3675, described in Tables 94–95. Results of the RTQ-PCR runs are shown in Tables 96–101.

TABLE 94

Probe Name Ag2541

| Primers | Sequences | | Length | Start Position |
|---|---|---|---|---|
| Forward | 5'-cgggaaatcatcagtcataatg-3' | (SEQ ID NO:259) | 22 | 383 |
| Probe | TET-5'-tccctcacctctaggctatggaggtt-3'-TAMRA | (SEQ ID NO:260) | 26 | 409 |
| Reverse | 5'-tgacagagcacgttgtttacag-3' | (SEQ ID NO:261) | 22 | 456 |

TABLE 95

Probe Name Ag3675

| Primers | Sequences | | Length | Start Position |
|---|---|---|---|---|
| Forward | 5'-cgggaaatcatcagtcataatg-3' | (SEQ ID NO:262) | 22 | 383 |
| Probe | TET-5'-tccctcacctctaggctatggaggtt-3'-TAMRA | (SEQ ID NO:263) | 26 | 409 |
| Reverse | 5'-tgacagagcacgttgtttacag-3' | (SEQ ID NO:264) | 22 | 456 |

TABLE 96

CNS_neurodegeneration_v1.0

| Tissue Name | Rel. Exp.(%) Ag2541, Run 206271442 | Tissue Name | Rel. Exp.(%) Ag2541, Run 206271442 |
|---|---|---|---|
| AD 1 Hippo | 8.2 | Control (Path) 3 Temporal Ctx | 2.4 |
| AD 2 Hippo | 36.6 | Control (Path) 4 Temporal Ctx | 50.0 |
| AD 3 Hippo | 6.0 | AD 1 Occipital Ctx | 23.2 |
| AD 4 Hippo | 9.5 | AD 2 Occipital Ctx (Missing) | 0.0 |
| AD 5 Hippo | 100.0 | AD 3 Occipital Ctx | 9.3 |
| AD 6 Hippo | 39.2 | AD 4 Occipital Ctx | 33.0 |
| Control 2 Hippo | 30.8 | AD 5 Occipital Ctx | 44.4 |
| Control 4 Hippo | 6.8 | AD 6 Occipital Ctx | 18.0 |
| Control (Path) 3 Hippo | 3.7 | Control 1 Occipital Ctx | 4.4 |
| AD 1 Temporal Ctx | 15.4 | Control 2 Occipital Ctx | 62.4 |
| AD 2 Temporal Ctx | 46.0 | Control 3 Occipital Ctx | 25.5 |
| AD 3 Temporal Ctx | 3.5 | Control 4 Occipital Ctx | 5.8 |
| AD 4 Temporal Ctx | 33.9 | Control (Path) 1 Occipital Ctx | 88.9 |
| AD 5 Inf Temporal Ctx | 100.0 | Control (Path) 2 Occipital Ctx | 12.9 |
| AD 5 Sup Temporal Ctx | 41.5 | Control (Path) 3 Occipital Ctx | 3.6 |
| AD 6 Inf Temporal Ctx | 24.8 | Control (Path) 4 Occipital Ctx | 21.5 |
| AD 6 Sup Temporal Ctx | 42.6 | Control 1 Parietal Ctx | 12.5 |
| Control 1 Temporal Ctx | 9.0 | Control 2 Parietal Ctx | 40.6 |
| Control 2 Temporal Ctx | 27.4 | Control 3 Parietal Ctx | 16.8 |
| Control 3 Temporal Ctx | 22.4 | Control (Path) 1 Parietal Ctx | 87.1 |
| Control 3 | 6.3 | Control (Path) 2 | 34.2 |

TABLE 96-continued

CNS_neurodegeneration_v1.0

| Tissue Name | Rel. Exp.(%) Ag2541, Run 206271442 | Tissue Name | Rel. Exp.(%) Ag2541, Run 206271442 |
|---|---|---|---|
| Temporal Ctx Control (Path) 1 Temporal Ctx | 47.3 | Parietal Ctx Control (Path) 3 Parietal Ctx | 3.1 |
| Control (Path) 2 Temporal Ctx | 37.4 | Control (Path) 4 Parietal Ctx | 41.8 |

TABLE 97

General_screening_panel_v1.4

| Tissue Name | Rel. Exp.(%) Ag3675, 218952739 | Tissue Name | Rel. Exp.(%) Ag3675, 218952739 |
|---|---|---|---|
| Adipose | 6.8 | Renal ca. TK-10 | 63.7 |
| Melanoma* Hs688(A).T | 12.8 | Bladder | 14.6 |
| Melanoma* Hs688(B).T | 17.1 | Gastric ca. (liver met.) NCI-N87 | 100.0 |
| Melanoma* M14 | 26.4 | Gastric ca. KATO III | 64.2 |
| Melanoma* LOXIMVI | 27.5 | Colon ca. SW-948 | 9.9 |
| Melanoma* SK-MEL-5 | 29.1 | Colon ca. SW480 | 33.7 |
| Squamous cell carcinoma SCC-4 | 8.1 | Colon ca.* (SW480 met) SW620 | 33.9 |
| Testis Pool | 9.0 | Colon ca. HT29 | 20.2 |
| Prostate ca.* (bone met) PC-3 | 51.8 | Colon ca. HCT-116 | 70.7 |
| Prostate Pool | 7.5 | Colon ca. CaCo-2 | 39.8 |
| Placenta | 1.9 | Colon cancer tissue | 16.3 |
| Uterus Pool | 4.7 | Colon ca. SW1116 | 7.9 |
| Ovarian ca. OVCAR-3 | 23.0 | Colon ca. Colo-205 | 7.8 |
| Ovarian ca. SK-OV-3 | 36.9 | Colon ca. SW-48 | 9.9 |
| Ovarian ca. OVCAR-4 | 4.5 | Colon Pool | 24.0 |
| Ovarian ca. OVCAR-5 | 80.1 | Small Intestine Pool | 23.3 |
| Ovarian ca. IGROV-1 | 12.6 | Stomach Pool | 18.3 |
| Ovarian ca. OVCAR-8 | 9.2 | Bone Marrow Pool | 7.9 |
| Ovary | 20.2 | Fetal Heart | 23.5 |
| Breast ca. MCF-7 | 35.4 | Heart Pool | 6.8 |
| Breast ca. MDA-MB-231 | 49.3 | Lymph Node Pool | 29.3 |
| Breast ca. BT 549 | 13.4 | Fetal Skeletal Muscle | 17.8 |
| Breast ca. T47D | 100.0 | Skeletal Muscle Pool | 19.9 |
| Breast ca. MDA-N | 11.6 | Spleen Pool | 8.2 |
| Breast Pool | 20.3 | Thymus Pool | 14.0 |
| Trachea | 13.8 | CNS cancer (glio/astro) U87-MG | 34.9 |
| Lung | 11.1 | CNS cancer (glio/astro) U-118-MG | 71.2 |
| Fetal Lung | 36.9 | CNS cancer (neuro;met) SK-N-AS | 13.1 |
| Lung ca. NCI-N417 | 5.8 | CNS cancer (astro) SF-539 | 16.6 |
| Lung ca. LX-1 | 64.2 | CNS cancer (astro) SNB-75 | 33.7 |
| Lung ca. NCI-H146 | 7.7 | CNS cancer (glio) SNB-19 | 9.0 |
| Lung ca. SHP-77 | 25.2 | CNS cancer (glio) SF-295 | 89.5 |
| Lung ca. A549 | 25.5 | Brain (Amygdala) Pool | 7.7 |
| Lung ca. NCI-H526 | 4.2 | Brain (cerebellum) | 6.6 |
| Lung ca. NCI-H23 | 36.1 | Brain (fetal) | 25.9 |
| Lung ca. NCI-H460 | 31.2 | Brain (Hippocampus) Pool | 9.2 |
| Lung ca. HOP-62 | 18.2 | Cerebral Cortex Pool | 10.2 |
| Lung ca. NCI-H522 | 36.3 | Brain (Substantia nigra) Pool | 7.6 |
| Liver | 1.7 | Brain (Thalamus) Pool | 12.7 |
| Fetal Liver | 21.5 | Brain (whole) | 9.5 |
| Liver ca. HepG2 | 36.6 | Spinal Cord Pool | 7.2 |
| Kidney Pool | 29.7 | Adrenal Gland | 11.0 |
| Fetal Kidney | 48.0 | Pituitary gland Pool | 3.4 |
| Renal ca. 786-0 | 24.3 | Salivary Gland | 6.5 |
| Renal ca. A498 | 5.3 | Thyroid (female) | 2.8 |
| Renal ca. ACHN | 25.7 | Pancreatic ca. CAPAN2 | 17.8 |
| Renal ca. UO-31 | 17.8 | Pancreas Pool | 26.1 |

TABLE 98

Panel 1.3D

| Tissue Name | Rel. Exp.(%) Ag2541, Run 155690258 | Tissue Name | Rel. Exp.(%) Ag2541, Run 155690258 |
|---|---|---|---|
| Liver adenocarcinoma | 9.9 | Kidney (fetal) | 4.3 |
| Pancreas | 5.8 | Renal ca. 786-0 | 10.0 |
| Pancreatic ca. CAPAN 2 | 3.4 | Renal ca. A498 | 31.6 |
| Adrenal gland | 6.3 | Renal ca. RXF 393 | 2.1 |
| Thyroid | 7.1 | Renal ca. ACHN | 6.0 |
| Salivary gland | 4.5 | Renal ca. UO-31 | 14.3 |
| Pituitary gland | 8.5 | Renal ca. TK-10 | 17.0 |
| Brain (fetal) | 9.2 | Liver | 3.4 |
| Brain (whole) | 8.2 | Liver (fetal) | 6.8 |
| Brain (amygdala) | 9.1 | Liver ca. (hepatoblast) HepG2 | 33.7 |
| Brain (cerebellum) | 3.8 | Lung | 4.0 |
| Brain (hippocampus) | 24.1 | Lung (fetal) | 8.0 |
| Brain (substantia nigra) | 1.5 | Lung ca. (small cell) LX-1 | 13.9 |
| Brain (thalamus) | 5.4 | Lung ca. (small cell) NCI-H69 | 4.3 |
| Cerebral Cortex | 9.0 | Lung ca. (s.cell var.) SHP-77 | 17.6 |
| Spinal cord | 3.8 | Lung ca. (large cell) NCI-H460 | 8.8 |
| glio/astro U87-MG | 19.3 | Lung ca. (non-sm. cell) A549 | 14.0 |
| glio/astro U-118-MG | 100.0 | Lung ca. (non-s.cell) NCI-H23 | 19.1 |
| astrocytoma SW1783 | 8.1 | Lung ca. (non-s.cell) HOP-62 | 7.6 |
| neuro*; met SK-N-AS | 27.5 | Lung ca. (non-s.cl) NCI-H522 | 10.7 |
| astrocytoma SF-539 | 14.6 | Lung ca. (squam.) SW 900 | 5.4 |
| astrocytoma SNB-75 | 15.9 | Lung ca. (squam.) NCI-H596 | 1.2 |
| glioma SNB-19 | 12.8 | Mammary gland | 18.3 |
| glioma U251 | 9.7 | Breast ca.* (pl.ef) MCF-7 | 16.5 |
| glioma SF-295 | 32.3 | Breast ca.* (pl.ef) MDA-MB-231 | 56.6 |
| Heart (fetal) | 2.6 | Breast ca.* (pl.ef) T47D | 12.9 |
| Heart | 3.7 | Breast ca. BT-549 | 11.5 |
| Skeletal muscle (fetal) | 19.8 | Breast ca. MDA-N | 12.9 |
| Skeletal muscle | 4.3 | Ovary | 15.2 |
| Bone marrow | 3.7 | Ovarian ca. OVCAR-3 | 14.6 |
| Thymus | 3.0 | Ovarian ca. OVCAR-4 | 0.1 |
| Spleen | 8.9 | Ovarian ca. OVCAR-5 | 40.1 |
| Lymph node | 5.4 | Ovarian ca. OVCAR-8 | 19.5 |
| Colorectal | 4.3 | Ovarian ca. IGROV-1 | 4.1 |
| Stomach | 14.8 | Ovarian ca.* (ascites) SK-OV-3 | 16.3 |
| Small intestine | 15.1 | Uterus | 6.3 |
| Colon ca. SW480 | 15.6 | Placenta | 4.7 |
| Colon ca.* SW620 (SW480 met) | 20.9 | Prostate | 2.9 |
| Colon ca. HT29 | 12.4 | Prostate ca.* (bone met) PC-3 | 13.3 |
| Colon ca. HCT-116 | 12.3 | Testis | 10.2 |
| Colon ca. CaCo-2 | 17.4 | Melanoma Hs688(A).T | 6.5 |
| Colon ca. tissue(ODO3866) | 13.8 | Melanoma* (met) Hs688(B).T | 2.5 |
| Colon ca. HCC-2998 | 37.9 | Melanoma UACC-62 | 2.0 |
| Gastric ca.* (liver met) NCI-N87 | 68.3 | Melanoma M14 | 4.2 |
| Bladder | 4.3 | Melanoma LOX IMVI | 7.2 |
| Trachea | 15.8 | Melanoma* (met) SK-MEL-5 | 9.2 |
| Kidney | 3.2 | Adipose | 3.9 |

TABLE 99

Panel 2D

| Tissue Name | Rel. Exp.(%) Ag2541, Run 155690621 | Tissue Name | Rel. Exp.(%) Ag2541, Run 155690621 |
|---|---|---|---|
| Normal Colon | 100.0 | Kidney Margin 8120608 | 13.3 |
| CC Well to Mod Diff (ODO3866) | 15.1 | Kidney Cancer 8120613 | 2.8 |
| CC Margin (ODO3866) | 10.3 | Kidney Margin 8120614 | 9.9 |
| CC Gr.2 rectosigmoid (ODO3868) | 15.1 | Kidbey Cancer 9010320 | 14.6 |
| CC Margin (ODO3868) | 5.6 | Kidney Margin 9010321 | 13.6 |
| CC Mod Diff (ODO3920) | 63.7 | Normal Uterus | 13.0 |
| CC Margin (ODO3920) | 15.7 | Uterus Cancer 064011 | 59.0 |
| CC Gr.2 ascend colon (ODO3921) | 46.3 | Normal Thyroid | 22.5 |
| CC Margin (ODO3921) | 15.5 | Thyroid Cancer 064010 | 17.3 |
| CC from Partial Hepatectomy (ODO4309) Mets | 56.6 | Thyroid Cancer A302152 | 26.8 |
| Liver Margin (ODO4309) | 36.3 | Thyroid Margin A302153 | 23.2 |
| Colon mets to lung (OD04451-01) | 8.5 | Normal Breast | 37.4 |
| Lung Margin (OD04451-02) | 0.9 | Breast Cancer (OD04566) | 25.3 |
| Normal Prostate 6546-1 | 24.8 | Breast Cancer (OD04590-01) | 60.3 |
| Prostate Cancer (OD04410) | 72.2 | Breast Cancer Mets (OD04590-03) | 57.8 |
| Prostate Margin (OD04410) | 57.4 | Breast Cancer Metastasis (OD04655-05) | 87.7 |
| Prostate Cancer (OD04720-01) | 59.9 | Breast Cancer 064006 | 12.7 |
| Prostate Margin (OD04720-02) | 100.0 | Breast Cancer 1024 | 44.8 |
| Normal Lung 061010 | 47.6 | Breast Cancer 9100266 | 22.4 |
| Lung Met to Muscle (ODO4286) | 30.4 | Breast Margin 9100265 | 27.2 |
| Muscle Margin (ODO4286) | 44.4 | Breast Cancer A209073 | 33.7 |
| Lung Malignant Cancer (OD03126) | 22.7 | Breast Margin A2090734 | 25.0 |
| Lung Margin (OD03126) | 26.1 | Normal Liver | 28.3 |
| Lung Cancer (OD04404) | 25.0 | Liver Cancer 064003 | 16.2 |
| Lung Margin (OD04404) | 24.7 | Liver Cancer 1025 | 11.8 |
| Lung Cancer (OD04565) | 9.3 | Liver Cancer 1026 | 4.0 |
| Lung Margin (OD04565) | 5.5 | Liver Cancer 6004-T | 14.8 |
| Lung Cancer (OD04237-01) | 71.2 | Liver Tissue 6004-N | 20.3 |
| Lung Margin (OD04237-02) | 15.8 | Liver Cancer 6005-T | 7.1 |
| Ocular Mel Met to Liver (ODO4310) | 52.5 | Liver Tissue 6005-N | 3.0 |
| Liver Margin (ODO4310) | 21.2 | Normal Bladder | 42.9 |
| Melanoma Mets to Lung (OD04321) | 25.0 | Bladder Cancer 1023 | 12.5 |
| Lung Margin (OD04321) | 16.0 | Bladder Cancer A302173 | 15.9 |
| Normal Kidney | 80.1 | Bladder Cancer (OD04718-01) | 27.9 |
| Kidney Ca, Nuclear grade 2 (OD04338) | 76.3 | Bladder Normal Adjacent (OD04718-03) | 27.2 |
| Kidney Margin (OD04338) | 48.0 | Normal Ovary | 13.2 |
| Kidney Ca Nuclear grade 1/2 (OD04339) | 60.3 | Ovarian Cancer 064008 | 64.2 |
| Kidney Margin (OD04339) | 60.7 | Ovarian Cancer (OD04768-07) | 66.9 |
| Kidney Ca, Clear cell type (OD04340) | 49.0 | Ovary Margin (OD04768-08) | 10.6 |
| Kidney Margin (OD04340) | 48.3 | Normal Stomach | 32.3 |
| Kidney Ca, Nuclear grade 3 (OD04348) | 9.9 | Gastric Cancer 9060358 | 4.0 |
| Kidney Margin (OD04348) | 19.1 | Stomach Margin 9060359 | 14.1 |
| Kidney Cancer (OD04622-01) | 9.5 | Gastric Cancer 9060395 | 25.2 |
| Kidney Margin (OD04622-03) | 3.7 | Stomach Margin 9060394 | 23.8 |
| Kidney Cancer (OD04450-01) | 42.0 | Gastric Cancer 9060397 | 82.9 |

TABLE 99-continued

| Panel 2D | | | |
|---|---|---|---|
| Tissue Name | Rel. Exp.(%) Ag2541, Run 155690621 | Tissue Name | Rel. Exp.(%) Ag2541, Run 155690621 |
| Kidney Margin (OD04450-03) | 25.5 | Stomach Margin 9060396 | 4.5 |
| Kidney Cancer 8120607 | 18.4 | Gastric Cancer 064005 | 41.5 |

TABLE 100

| Panel 4.1D | | | |
|---|---|---|---|
| Tissue Name | Rel. Exp.(%) Ag3675, Run 169976076 | Tissue Name | Rel. Exp.(%) Ag3675, Run 169976076 |
| Secondary Th1 act | 29.3 | HUVEC IL-1 beta | 44.1 |
| Secondary Th2 act | 55.1 | HUVEC IFN gamma | 41.2 |
| Secondary Tr1 act | 50.3 | HUVEC TNF alpha + IFN gamma | 26.2 |
| Secondary Th1 rest | 9.0 | HUVEC TNF alpha + IL4 | 42.3 |
| Secondary Th2 rest | 18.8 | HUVEC IL-11 | 15.8 |
| Secondary Tr1 rest | 17.2 | Lung Microvascular EC none | 58.6 |
| Primary Th1 act | 52.5 | Lung Microvascular EC TNF alpha + IL-1 beta | 51.1 |
| Primary Th2 act | 51.8 | Microvascular Dermal EC none | 42.3 |
| Primary Tr1 act | 67.4 | Microsvasular Dermal EC TNF alpha + IL-1 beta | 27.9 |
| Primary Th1 rest | 20.7 | Bronchial epithelium TNF alpha + IL1 beta | 19.9 |
| Primary Th2 rest | 18.2 | Small airway epithelium none | 9.5 |
| Primary Tr1 rest | 48.0 | Small airway epithelium TNF alpha + IL-1 beta | 11.3 |
| CD45RA CD4 lymphocyte act | 61.1 | Coronery artery SMC rest | 17.6 |
| CD45RO CD4 lymphocyte act | 83.5 | Coronery artery SMC TNF alpha + IL-1 beta | 12.2 |
| CD8 lymphocyte act | 65.1 | Astrocytes rest | 18.2 |
| Secondary CD8 lymphocyte rest | 61.1 | AstrocytesTNF alpha + IL-1 beta | 13.5 |
| Secondary CD8 lymphocyte act | 25.3 | KU-812 (Basophil) rest | 75.3 |
| CD4 lymphocyte none | 33.4 | KU-812 (Basophil) PMA/ionomycin | 82.9 |
| 2ry Th1/Th2/Tr1_anti-CD95 CH11 | 12.4 | CCD1106 (Keratinocytes) none | 47.0 |
| LAK cells rest | 23.8 | CCD1106 (Keratinocytes) TNF alpha + IL-1 beta | 22.4 |
| LAK cells IL-2 | 35.6 | Liver cirrhosis | 12.4 |
| LAK cells IL-2 + IL-12 | 47.6 | NCI-H292 none | 42.9 |
| LAK cells IL-2 + IFN gamma | 62.4 | NCI-H292 IL-4 | 27.2 |
| LAK cells IL-2 + IL-18 | 58.6 | NCI-H292 IL-9 | 44.1 |
| LAK cells PMA/ionomycin | 5.8 | NCI-H292 IL-13 | 68.8 |
| NK cells IL-2 rest | 27.4 | NCI-H292 IFN gamma | 47.6 |
| Two Way MLR 3 day | 26.2 | HPAEC none | 36.6 |
| Two Way MLR 5 day | 37.9 | HPAEC TNF alpha + IL-1 beta | 43.5 |
| Two Way MLR 7 day | 18.3 | Lung fibroblast none | 56.3 |
| PBMC rest | 13.6 | Lung fibroblast TNF alpha + IL-1 beta | 20.4 |
| PBMC PWM | 30.1 | Lung fibroblast IL-4 | 52.9 |
| PBMC PHA-L | 33.7 | Lung fibroblast IL-9 | 75.3 |
| Ramos (B cell) none | 100.0 | Lung fibroblast IL-13 | 54.3 |
| Ramos (B cell) ionomycin | 74.2 | Lung fibroblast IFN gamma | 47.6 |
| B lymphocytes PWM | 48.6 | Dermal fibroblast CCD1070 rest | 41.8 |
| B lymphocytes CD40L and IL-4 | 54.3 | Dermal fibroblast CCD1070 TNF alpha | 42.0 |

TABLE 100-continued

Panel 4.1D

| Tissue Name | Rel. Exp.(%) Ag3675, Run 169976076 | Tissue Name | Rel. Exp.(%) Ag3675, Run 169976076 |
|---|---|---|---|
| EOL-1 dbcAMP | 23.3 | Dermal fibroblast CCD1070 IL-1 beta | 27.5 |
| EOL-1 dbcAMP PMA/ionomycin | 12.9 | Dermal fibroblast IFN gamma | 25.3 |
| Dendritic cells none | 15.9 | Dermal fibroblast IL-4 | 50.3 |
| Dendritic cells LPS | 3.5 | Dermal Fibroblasts rest | 42.9 |
| Dendritic cells anti-CD40 | 10.7 | Neutrophils TNFa + LPS | 0.0 |
| Monocytes rest | 13.5 | Neutrophils rest | 0.3 |
| Monocytes LPS | 5.2 | Colon | 10.5 |
| Macrophages rest | 6.5 | Lung | 6.7 |
| Macrophages LPS | 1.2 | Thymus | 19.3 |
| HUVEC none | 38.7 | Kidney | 48.3 |
| HUVEC starved | 34.6 | | |

TABLE 101

Panel 4D

| Tissue Name | Rel. Exp. (%) Ag2541, Run 155690634 | Tissue Name | Rel. Exp. (%) Ag2541, Run 155690634 |
|---|---|---|---|
| Secondary Th1 act | 11.5 | HUVEC IL-1 beta | 8.1 |
| Secondary Th2 act | 10.0 | HUVEC IFN gamma | 15.4 |
| Secondary Tr1 act | 8.7 | HUVEC TNF alpha + IFN gamma | 7.1 |
| Secondary Th1 rest | 1.0 | HUVEC TNF alpha + IL4 | 12.6 |
| Secondary Th2 rest | 2.3 | HUVEC IL-11 | 3.6 |
| Secondary Tr1 rest | 5.4 | Lung Microvascular EC none | 17.3 |
| Primary Th1 act | 12.6 | Lung Microvascular EC TNF alpha + IL-1 beta | 8.5 |
| Primary Th2 act | 12.5 | Microsvascular Dermal EC none | 14.4 |
| Primary Tr1 act | 21.9 | Microsvascular Dermal EC TNF alpha + IL-1 beta | 6.4 |
| Primary Th1 rest | 28.3 | Bronchial epithelium TNF alpha + IL1 beta | 0.5 |
| Primary Th2 rest | 13.1 | Small airway epithelium none | 3.5 |
| Primary Tr1 rest | 14.4 | Small airway epithelium TNF alpha + IL-1 beta | 17.1 |
| CD45RA CD4 lymphocyte act | 13.0 | Coronery artery SMC rest | 10.3 |
| CD45RO CD4 lymphocyte act | 15.8 | Coronery artery SMC TNF alpha + IL-1 beta | 4.6 |
| CD8 lymphocyte act | 15.1 | Astrocytes rest | 7.4 |
| Secondary CD8 lymphocyte rest | 10.7 | Astrocytes TNF alpha + IL-1 beta | 2.8 |
| Secondary CD8 lymphocyte act | 5.1 | KU-812 (Basophil) rest | 15.9 |
| CD4 lymphocyte none | 6.9 | KU-812 (Basophil) PMA/ionomycin | 16.7 |
| 2ry Th1/Th2/Tr1_anti-CD95 CH11 | 2.8 | CCD1106 (Keratinocytes) none | 8.8 |
| LAK cells rest | 6.8 | CCD1106 (Keratinocytes) TNF alpha + IL-1 beta | 0.5 |
| LAK cells IL-2 | 10.8 | Liver cirrhosis | 2.1 |
| LAK cells IL-2 + IL-12 | 10.4 | Lupus kidney | 1.8 |
| LAK cells IL-2 + IFN gamma | 22.5 | NCI-H292 none | 30.1 |
| LAK cells IL-2 + IL-18 | 25.7 | NCI-H292 IL-4 | 32.5 |
| LAK cells PMA/ionomycin | 1.3 | NCI-H292 IL-9 | 44.8 |
| NK Cells IL-2 rest | 7.0 | NCI-H292 IL-13 | 17.3 |
| Two Way MLR 3 day | 11.4 | NCI-H292 IFN gamma | 21.0 |
| Two Way MLR 5 day | 3.4 | HPAEC none | 12.7 |
| Two Way MLR 7 day | 3.2 | HPAEC TNF alpha + IL-1 beta | 5.9 |
| PBMC rest | 2.9 | Lung fibroblast none | 10.1 |
| PBMC PWM | 17.0 | Lung fibroblast TNF alpha + IL-1 beta | 4.3 |
| PBMC PHA-L | 9.4 | Lung fibroblast IL-4 | 28.3 |
| Ramos (B cell) none | 28.7 | Lung fibroblast IL-9 | 16.8 |
| Ramos (B cell) ionomycin | 100.0 | Lung fibroblast IL-13 | 14.7 |
| B lymphocytes PWM | 64.2 | Lung fibroblast IFN gamma | 24.0 |

TABLE 101-continued

Panel 4D

| Tissue Name | Rel. Exp. (%) Ag2541, Run 155690634 | Tissue Name | Rel. Exp. (%) Ag2541, Run 155690634 |
|---|---|---|---|
| B lymphocytes CD40L and IL-4 | 23.7 | Dermal fibroblast CCD1070 rest | 25.7 |
| EOL-1 dbcAMP | 6.6 | Dermal fibroblast CCD1070 TNF alpha | 40.9 |
| EOL-1 dbcAMP PMA/ionomycin | 5.4 | Dermal fibroblast CCD1070 IL-1 beta | 7.5 |
| Dendritic cells none | 4.0 | Dermal fibroblast IFN gamma | 9.0 |
| Dendritic cells LPS | 0.1 | Dermal fibroblast IL-4 | 22.5 |
| Dendritic cells anti-CD40 | 3.4 | IBD Colitis 2 | 1.0 |
| Monocytes rest | 4.0 | IBD Crohn's | 1.0 |
| Monocytes LPS | 0.4 | Colon | 6.0 |
| Macrophages rest | 3.5 | Lung | 4.3 |
| Macrophages LPS | 0.6 | Thymus | 14.4 |
| HUVEC none | 19.3 | Kidney | 6.0 |
| HUVEC starved | 24.7 | | |

CNS_neurodegeneration_v1.0 Summary: Ag3675 This panel confirms the expression of the CG50287-01 gene at moderate level in the CNS in an independent group of patients. However, no differential expression of this gene was found between Alzheimer's disease and control post-mortem brains. Please see Panel 1.3D for a discussion of the potential utility of this gene in the central nervous system. Results from one experiment (Run 211141341) with this gene are not included because the amp plot indicates that there were experimental difficulties with this run (data not shown).

General_screening_panel_v1.4 Summary: Ag3675 Expression of the CG50287-01 gene is highest in samples derived from gastric and breast cancer cell lines (CT=27.6). Thus, the expression of this gene could be used to distinguish the gastric and breast cancer cell lines from the other samples in the panel. In addition, there is substantial expression of this gene in a number of cancer-derived cell lines including brain, colon, ovarian and lung cancer. Therefore, therapeutic modulation of the activity of this gene or its protein product, through the use of small molecule drugs, antibodies or protein therapeutics, might be beneficial in the treatment of gastric, colon, breast, lung and ovarian cancer.

This panel confirms the expression of this gene at moderate levels in all central nervous system regions examined. Please see Panel 1.3D for a discussion of the potential utility of this gene in the central nervous system.

This gene is expressed at low to moderate levels in the metabolic and endocrine tissues on this panel, including in adipose, pancreas, heart, skeletal muscle, liver, adrenal gland, pituitary gland, and thyroid. Interestingly, this gene is expressed at higher levels in fetal liver (CT=29.8) than adult liver (CT=33.4), suggesting that expression of this gene can be used to distinguish these two tissues. Furthermore, relative overexpression of this gene in fetal liver suggests that the protein product may enhance liver growth or development in the fetus and thus may also act in a regenerative capacity in the adult. This gene encodes a protein with homology to methionyl aminopeptidase, an important enzyme in post-translational regulation of many proteins and peptides. Therefore, therapeutic modulation of this gene or its protein product may prove useful in the treatment of endocrine and metabolic disorders, including obesity and diabetes.

Panel 1.3D Summary: Ag3675 Expression of the CG50287-01 gene is highest in a sample derived from a brain cancer cell line (CT=28.6). Thus, expression of this gene could be used to distinguish brain cancer cell lines from the other samples in the panel. In addition, there appears to be substantial expression of this gene associated with a number of cancer-derived cell lines including brain, colon, ovarian and breast cancer. Therefore, therapeutic modulation of the activity of this gene or its protein product, through the use of small molecule drugs, antibodies or protein therapeutics, might be beneficial in the treatment of colon, breast, brain and ovarian cancer.

This gene is expressed at low to moderate levels in all central nervous system regions examined, including amygdala, cerebellum, hippocampus, substantia nigra, cerebral cortex, thalamus and spinal cord (CTs=30.6–34.6). This gene encodes a protein with homology to methionyl aminopeptidase (Aminopeptidase M). Aminopeptidase M acts as a hypotensive agent when delivered directly into the paraventricular nucleus of rats. Therefore, therapeutic modulation of this gene or its protein product may be of use in the treatment of high blood pressure.

This gene is expressed at low to moderate levels in the metabolic and endocrine tissues on this panel, including in adipose, pancreas, heart, skeletal muscle, liver, adrenal gland, pituitary gland, and thyroid. Therefore, therapeutic modulation of this gene or its protein product may prove useful in the treatment of endocrine and metabolic disorders, including obesity and diabetes (Batt C M, Jensen L L, Harding J W, Wright J W. Microinfusion of aminopeptidase M into the paraventricular nucleus of the hypothalamus in normotensive and hypertensive rats. Brain Res Bull 1996;39 (4):235–40).

Panel 2D Summary: Ag2541 Expression of the CG50287-01 gene is highest in a sample derived from normal prostate tissue adjacent to a prostate cancer (CT=29.6). Thus, expression of this gene could be used to distinguish normal prostate tissue from the other samples in the panel. In addition, there is substantial expression of this gene in a number of samples derived from cancer tissue in comparison to their respective controls. For instance, there appears to be substantial expression of this gene in gastric cancer, ovarian cancer, breast cancer, lung cancer, uterine cancer and colon cancer. Thus, expression of this gene could also be used to distinguish malignant tissue from normal tissue in these cases. Moreover, therapeutic modulation of the activity of this gene or its protein product, through the use of small molecule drugs, protein therapeutics or antibodies, could be beneficial in the treatment of gastric, ovarian, breast, lung, uterian or colon cancers.

Panel 4.1D Summary: Ag3675 The CG50287-01 gene is expressed at low to moderate levels in almost all of the tissues on this panel. However, expression of this gene is high in the ionomycin-activated Ramos B cell line (CT=28) as well as in pokeweed mitogen-activated isolated peripheral blood B lymphocytes (CT=29.1). Therefore, antibodies and small molecules that antagonize the activity of the CG50287-01 protein may be useful to treat the symptoms in patients with autoimmune and inflammatory diseases in which B cells act as antigen presenting cells, such as lupus erythematosus, asthma, emphysema, Crohn's disease, ulcerative colitis, multiple sclerosis, rheumatoid arthritis, osteoarthritis, and psoriasis.

Panel 4D Summary: Ag2541 Please see Panel 4.1D summary.

OTHER EMBODIMENTS

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

SEQUENCE LISTING (264 sequences)

SEQ ID NO: 1 - DNA, 8438 bp, Homo sapiens
gccatggacgtgaaggagaggaagccttaccgctcgctgacccggcgccgcgacgccgagcgccgctacaccagctcgtccgcggacagcgaggagggcaaagccccgcagaaatcgtacagctccagcgagaccctgaaggcctacgaccaggacgcccgcctagcctatggcagccgcgtcaaggacattgtgccgcaggaggccgaggaattctgccgcacaggtgccaacttcaccctgcgggagctggggctggaagaagtaacgccccctcacgggaccctgtaccggacagacattggcctcccccactgcggctactccatgggggctggctctgatgccgacatggaggctgacacggtgctgtcccctgagcaccccgtgcgtctgtggggccggagcacacggtcagggcgcagctcctgcctgtccagccgggccaattccaatctcacactcaccgacaccgagcatgaaaacactgagactgatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactctcctccgccccgacccctgccccgcagcaccttcgcctggccggcctttaacctcaagaagccctccaagtactgtaactggaagtgcgcagccctgagcgccatcgtcatctcagccactctggtcatcctgctggcatactttgtggccatgcacctgtttggcctaaactggcacctgcagccgatggaggggcagatgacggatttatgagatcacggaggacacagccagcagttggcctgtgccaaccgacgtctccctatacccctcagggggcactggcttagagacccctgacaggaaaggcaaaggaaccacagaaggaaagcccagtagtttctttccagaggccagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacagtttgactttgtggagctgctggatggcaggaggctcctaacccaggaggcgcggagcctagaggggaccccgcgccagtctcggggaactgtgcccccctccagccatgagacaggcttcatccagtatttggattcaggaatctggcacttggctttttacaatgacggaaaggagtcagaagtggtttcctttctcaccactgccattcttgattcctgggctctctgtttgggtgatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcctgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgccgcgacggcaagtgcgagtgcagccctggctggaatggcgaacactgcaccatctccctagctcactatctggatagggtagttaaactttcagagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggagatggcctggtggactgcatggaccctgactgctgcctccagcccctgtgccatatcaacccgctgtgccttggctcccctaaccctctggacatcatccaggagacacaggtccctgtgtcacagcagaacctacactccttctatgaccgcatcaagttcctcgtgggcagggacagcacgcacataatccccggggagaacccctttgatggagggcatgcttgtgttattcgtggccaagtgatgacatcagatggaacccccctggttggtgtgaacatcagttttgtcaataaccctctctttggatatacaatcagcaggcaagatggcagctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcaggctttgcaggaggaaatctctatctctggctgcaagatgaggctgagctacctgagcagccggacccctggctacaaatctgtcctgaggatcagcctcacccacccgaccatccccttcaacctcatgaaggtgcacctcatggtagcggtggagggccgcctcttcaggaagtggttcgctgcagccccagacctgtcctattatttcatttgggacaagacagacgtctacaaccagaaggtgtttgggctttcagaagcctttgtttccgtgggttatgaatatgaatcctgcccagatctaatcctgtgggaaaaaagaacaacagtgctgcagggctatgaaattgacgcgtccaagcttggaggatggagcctagacaaacatcatgccctcaacattcaaagtggtggcatcctgcacaaagggaatggggagaaccagtttgtgtctcagcagcctcctgtcattgggagcatcatgggcaatgggcgccggagaagcatctcctgccccagctgcaacggccttgctgacggcaacaagctcctggccccagtggccctcacctgtggctctgacgggagcctctatgtgggtgatttcaactacattagaaggatcttcccctctggaaatgtcaccaacatcctagagctgagggtcagaaataaagatttcagacatagtcacagtccagcacacaaatactacctggccacagaccccatgagtggggccgtcttcctttctgacagcaacagccggcgggtctttaaaatcaagtccactgtggtggtgaaggaccttgtcaagaactctgaggtggttgcggggacaggtgaccagtgcctcccctttgatgacactcgctgcggggatggtgggaaggccacagaagccacactcaccaatcccaggggtcccccaggcattacagtggacaagtttgggctgatctacttcgtggatggcaccatgatcagacgcatcgatcagaatgggatcatctccaccctgctcggctctaatgatctcacatcagcccggccactcagctgtgattctgtcatggatatttcccaggtaagacaggttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtacgacagctttggccgcctgacaaatgtgaccttccctactggccaggtgagcagtttccgaagtgatacagacagttcagtgcatgtccaggtagagacctccagcaaggatgatgtcaccataaccaccaacctgtctgcctcaggcgccttctacacactgctgcaagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggtgctccaggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaaggcaggtgtccagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaaggtaattcctgcacaaggctgccagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactctttt

SEQ ID NO: 2 - protein, 2794 aa, Homo sapiens
MDVKERKPYRSLTRRRDAERRYTSSSADSEEGKAPQKSYSSSETLKAYDQDARLAYGSRVKDIVPQEAEEFCRTGANFTLRELGLEEVTPPHGTLYRTDIGLPHCGYSMGAGSDADMEADTVLSPEHPVRLWGRSTRSGRSSCLSSRANSNLTLTDTEHENTETDHPGGLQNHARLRTPPPPLSHAHTPNQHHAASINSLNRGNFTPRSNPSPAPTDHSLSGEPPAGGAQEPAHAQENWLLNSNIPLETRNLGKQPFLGTLQDNLIEMDILGASRHDGAYSDGHFLFKPGGTSPLFCTTSPGYPLTSSTVYSPPPRPLPRSTFAWPAFNLKKPSKYCNWKCAALSAIVISATLVILLAYFVAMHLFGLNWHLQPMEGQMYEITEDTASSWPVPTDVSLYPSGGTGLETPDRKGKGTTEGKPSSFFPEASFIDSGEIDVGRRASQKIPPGTFWRSQVFIDHPVHLKFNVSLGKAALVGIYGRKGLPPSHTQFDFVELLDGRRLLTQEARSLEGTPRQSRGTVPPSSHETGFIQYLDSGIWHLAFYNDGKESEVVSFLTTAILDSWALCLGDGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCRDGKCECSPGWNGEHCTISLAHYLDRVVKLSEGCPGLCNGNGRCTLDLNGWHCVCQLGWRGAGCDTSMETACGDSKDNDGDGLVDCMDPDCCLQPLCHINPLCLGSPNPLDIIQETQVPVSQQNLHSFYDRIKFLVGRDSTHIIPGENPFDGGHACVIRGQVMTSDGTPLVGVNISFVNNPLFGYTISRQDGSFDLVTNGGISIILRFERAPFITQEHTLWLPWDRFFVMETIIMRHEENEIPSCDLSNFARPNPVVSPSPLTSFASSCAEKGPIVPEIQALQEEISISGCKMRLSYLSSRTPGYKSVLRISLTHPTIPFNLMKVHLMVAVEGRLFRKWFAAAPDLSYYFIWDKTDVYNQKVFGLSEAFVSVGYEYESCPDLILWEKRTTVLQGYEIDASKLGGWSLDKHHALNIQSGGILHKGNGENQFVSQQPPVIGSIMGNGRRRSISCPSCNGLADGNKLLAPVALTCGSDGSLYVGDFNYIRRIFPSGNVTNILELRVRNKDFRHSHSPAHKYYLATDPMSGAVFLSDSNSRRVFKIKSTVVVKDLVKNSEVVAGTGDQCLPFDDTRCGDGGKATEATLTNPRGPPGITVDKFGLIYFVDGTMIRRIDQNGIISTLLGSNDLTSARPLSCDSVMDISQVRQVHLEWPTDLAINPMDNSLYVLDNNVVLQISENHQVRIVAGRPMHCQVPGIDHFLLSKVAIHATLESATALAVSHNGVLYIAETDEKKINRIRQVTTSGEISLVAGAPSGCDCKNDANCDCFSGDDGYAKDAKLNTPSSLAVCADGELYVADLGNIRIRFIRKNKPFLNTQNMYELSSPIDQELYLFDTTGKHLYTQSLPTGDYLYNFTYTGDGDITLITDNNGNMVNVRRDSTGMPLWLVVPDGQVYWVTMGTNSALKSVTTQGHELAMMTYHGNSGLLATKSNENGWTTFYEYDSFGRLTNVTFPTGQVSSFRSDTDSSVHVQVETSSKDDVTITTNLSASGAFYTLLQDQVRNSYYIGADGSLRLLLANGMEVALQTEPHLLAGTVNPTVGKRNVTLPIDNGLNLVEWRQRKEQARGQVTVFGRRLRVLQVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKAGVQSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQAVINETPLPIDLYRYDDVSGKTEQFGKFGVIYYDINQIITTAVMTHTKHFDAYGRMKEVQYEIFRSLMYWMTVQYDNMGRVVKKELKVGPYANTTRYSYEYDADGQLQTVSINDKPLWRYSYDLNGNLHLLSPGNSARLTPLRYDIRDRITRLGDVQYKMDEDGFLRQRGGDIFEYNSAGLLIKAYNRAGSWSVRYRYDGLGRRVSSKSSHSHHLQFFYADLTNPTKVTHLYNHSSSEITSLYYDLQGHLFAMELSSGDEFYIACDNIGTPLAVFSGTGLMIKQILYTAYGEIYMDTNPNFQIIIGYHGGLYDPLTKLVHMGRRDYDVLAGRWTSPDHELWKHLSSSNVMPFNLYMFKNNNPISNSQDIKCFMTDVNSWLLTFGFQLHNVIPGYPKPDMDAMEPSYELIHTQMKTQEWDNSKVIPAQGCQSILGVQCEVQKQLKAFVTLERFDQLYGSTITSCQQAPKTKKFASSGSVFGKGVKFALKDGRVTTDIISVANEDGRRVAAILNHAHYLENLHFTIDGVDTHYFVKPGPSEGDLAILGLSGGRRTLENGVNVTVSQINTVLNGRTRRYTDIQLQYGALCLNTRYGTTLDEEKARVLELARQRAVRQAWAREQQRLREGEEGLRAWTEGEKQQVLSTGRVQGYDGFFVISVEQYPELSDSANNIHFMRQSEMGRR

SEQ ID NO: 3 - DNA, 1024 bp, Homo sapiens
ctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaaggaccatgctggccttcttgtggatggtgagctgtactcggccacactcaacaacttcctgggcacggaacccattatcctgcgtaacatggggccccaccactccatgaagacagagtacctggccttttggctcaacggggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacac

SEQ ID NO: 4 - protein, 805 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKDHAGLLVDGELYSATLNNFLGTEPIILRNMGPHHSMKTEYLAFWLNGERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 5 - DNA, 1933 bp, Homo sapiens
aacttcaccccagccttgcaaagtacagtcacctagttggtgttgtaattgtgacttcaaaaggccattccaccattctgtcaatccagctgattcagtatgatggagaacatggtaaaaccagtgaattccatgagcatgagcccactgccgcacgtctttagccgtaaagtgagtgctttggtcagaggcaatcctccatctccaggctctgctgccacttcaggcttttccttgtgggtatctcagcctcctagccagccatggggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagcatttctgataaggaaggaactcctggtgtgcagatcggtgggatggttcccagagccctgggccaagtggagagaacctcaaggcagggtacttccatccctgtcagaggcccactctctggaaaaagctgggctcttccaaatagcagtgtctagcagagtcagggacagcacactggggaatgtgtcctgcaccatccacaacatggcccttggccaagagaagaccacagctgtggtcatatcagccccatctgtggggagtctctccccctcagcagtggctctggctgtgatcctgcctgtcctggtacttctcatcatggtgtgcctttgccttatcaaggcagtggcaaaaaatctcattatcttttcctttcttcctctagacaatcttctttcagaccatgctaaagaaaaaggtaatgatataaaagtagggaacgtttcttctttcatagagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttc

SEQ ID NO: 6 - protein, 579 aa, Homo sapiens [sequence omitted]

SEQ ID NO: 7 - DNA, 748 bp, Homo sapiens
ccctcacagaggccaaactgatataaatctgcttaggaggcctgattcacagacgctacaggatggagcggggcgcaggagccaagctgctgccgctgctgctgcttctgcgggcgactggtttcacatgtgcacagacaggtggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagttggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttga

SEQ ID NO: 8 - protein, 202 aa, Homo sapiens
MERGAGAKLLPLLLLLRATGFTCAQTGGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 9 - DNA, 582 bp, Homo sapiens
agtggattagttttgggtttcacttaatctgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacaggcagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaaggtggggcgcaggggtcgaggatcccttggggtgatgtatgtcccttaccctctattacatactccgtcgcaacaggcaggctggctccgccagagctacggggcagtatagaccggggaggcgaagggtggatggaagacccctcctccgctcctc

SEQ ID NO: 10 - protein, 114 aa, Homo sapiens [sequence omitted]

SEQ ID NO: 11 - DNA, 7676 bp, Homo sapiens
gaaactggttttcacaggtgatagatggaaggctgttttcaaaagatcaagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagttttctcactcccaggagcctgagtccaaccccatccagcccaggcagtccttgtagtcctctcttggcctttcacttttggagccctgtgtgtccaaatgctgggtgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacagcttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctggagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccag

SEQ ID NO: 12 - protein, 2545 aa, Homo sapiens
MEGCFQKIKLDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFLTPRSLSPTPSSPGSPCSPLLAFHFWSPVCPNAGCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDSLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLEPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 13 - DNA, 1119 bp, Homo sapiens
agcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggatttgaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctga

SEQ ID NO: 14 - protein, 354 aa, Homo sapiens
MDMMLLVQGACCSNQWLAAVLLSLCCLLPSCLPAGQSVDFPWAAVDNMMVRKGDTADLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 15 - DNA, 3092 bp, Homo sapiens
atggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacgtattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctggtttccagcacaagttcacggtgcaggcctcccctaccatggataaaaggaagagtcttatcaacagccgctccagtcctcctgcaagccccaccatcattcctcgccttcgagccatccagtgtgagactgtttcccaaattagctggggccagaacacacaggggcacctgtccgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaactcaagtccctggtagatggatataagcagtggtcgtccagtgcccccaacctggtgaagggcccaaggagtaccccggccctgccagggttcaccagccttatggagatggaggatgaggacagtgaaggcccagggagtggagagagtcgcctacagcattcacccagccagtcctacctctgtatcccattccctcgtggagagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcagtccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccgggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattgggg

SEQ ID NO: 16 - protein, 1024 aa, Homo sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSGFQHKFTVQASPTMDKRKSLINSRSSPPASPTIIPRLRAIQCETVSQISWGQNTQGHLSESSKTWGRSSVVPKEEGEEEEKRAPKKKGRTWGPGTLGQKELASGDELKSLVDGYKQWSSSAPNLVKGPRSTPALPGFTSLMEMEDEDSEGPGSGESRLQHSPSQSYLCIPFPRGEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLQSDSDEIVVYEMPVSPVEAPPLSPCTHNPLVNVRVERFKRDPNQSLTPTHVTLTTPSQPSSHRRTPSDGALKPETLLASRSPSPSRDPGEFPRLPDPNVVFPPTPRRWNTQQDSTLERPKTLEFLPRPRPSANRQRLDPWWFVSPSHARSTSPANSSSTETPGPLPPTERTLLDLDAEGQSQDSTVPLCRAELNTHRPAPYEIQQEFWS

SEQ ID NO: 17 - DNA, 834 bp, Homo sapiens
atgacatggcgggcagtggtcaggatactgacctgggctgccctacaggtgttggtaagttggttatcatgccctctctcacccctaccacagctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccgcctgagcctggaaagaccacagcactgtgatggag

SEQ ID NO: 18 - protein, 204 aa, Homo sapiens
MRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 19 - DNA, 3981 bp, Homo sapiens
atgcagaaagccatccgacttaatgatggccacgtcgcgcccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctttgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgtgcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgcccgaat

SEQ ID NO: 20 - protein, 1257 aa, Homo sapiens
MQKAIRLNDGHVAPLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 21 - DNA, 480 bp, Homo sapiens
atggtcctgagtggggcgctgtgcttcagaatgaaggactcggcattgaaggtgctttatctgcataataaccagcttctagctggagggctgcatgcagggaaggtctccctcctagagaagatctgcatacttcctaacagaggcttggcccgcaccaaggtccccattttcctggggatccagggagggagccgctgcctggcatgtgtggagacagaagaggggccttccctacagctggagcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaac

SEQ ID NO: 22 - protein, 157 aa, Homo sapiens
MVLSGALCFRMKDSALKVLYLHNNQLLAGGLHAGKVSLLEKICILPNRGLARTKVPIFLGIQGGSRCLACVETEEGPSLQLEQPVNIMELYLGAKESKSFTFYRRDMGLTSSFESAAYPGWFLCTVPEADQPVRLTQLPENGGWNAPITDFYFQQCD

SEQ ID NO: 23 - DNA, 1599 bp, Homo sapiens
ttactatgagtctgctaaactgtgaaaacaggtgtggatccagccagtctcaaagtgactactgtgtggccatggccagctcctgtagcgcagcaacaaaaaatgatagtgtgggcagaactgccagcacggggaacctcttcagctcctttatggaggagatccagggatatgatgtagagtttggcccacccctggaaagcaagtatgaatgccccatctgcttgatggcattacgagaagcagtgcaaacgccatgcagccataggttctgcaaagcctgcatcataaaatcaataagggatgcaggtcacaaatatccagttgacaatgaaatactgctggaaaataaactatttccagacaattttgcaaaacgtgagattatttctctgatagtgaagtgtccaaatgaaggttgtttgcacaagatggaactgagacatcttgaggatcatcaaacacattgtgagtttgctcttatggattgtccccaatgccagcctcccttccaaaaattccatattaatatttacattatgaagggttgtccaaggaggcaggtatcttgtgacaactgtgctgcatcaatggcatttgaagataaaaagatccatgaccagaactgccctttggcaaatgtcatctgtgagtactgcaatactatactcatcagagaacagatgcctaactttatgacctatgacctagaccgccctacagccccaattccatgcacattccgtacttttcgtagccatgaaaagatgcggaggaatcacttggcacgccacctacaagagaacacccaatcaaacatgagaatgttggcccaggctgttcatagtttgagccttatacccgactctgggtatatctcagaggtccggaatttccaggaaagtattcaccagttagagggtcgccttgtaagacaatgtcatcaaatccgggagctgactgataaaatggaaactcagagtatgtatgtaagtgagctcaaacgaaccattcgaacccttgaggacaaagttgctgaaattgaagcacagcagtgcaatggaatttacatttggaagattgggaatgaatttgaaatgttaagaagagcagaaaccgaagagcagaaacctgttgtgattcatagccctggattctacacgggtaaacacaggtacaaactgtgcatgcgcttgcaccttccgttaccgactgctcagcgctgtgcaaactatatatccctttttgtccacacaatgcaaggagagtatgacagccacctcccttggcccttccaggatacaatatgccttacaattcttgatcagtctcaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcactgtgaggtctccacccgctttgacatggatagccttcagagggagggttttcagccacaaagtactgatgcaggggtatagcttgccctcactt

SEQ ID NO: 24 - protein, 526 aa, Homo sapiens
MSLLNCENRCGSSQSQSDYCVAMASSCSAATKNDSVGRTASTGNLFSSFMEEIQGYDVEFGPPLESKYECPICLMALREAVQTPCSHRFCKACIIKSIRDAGHKYPVDNEILLENKLFPDNFAKREIISLIVKCPNEGCLHKMELRHLEDHQTHCEFALMDCPQCQPPFQKFHINIYIMKGCPRRQVSCDNCAASMAFEDKKIHDQNCPLANVICEYCNTILIREQMPNFMTYDLDRPTAPIPCTFRTFRSHEKMRRNHLARHLQENTQSNMRMLAQAVHSLSLIPDSGYISEVRNFQESIHQLEGRLVRQCHQIRELTDKMETQSMYVSELKRTIRTLEDKVAEIEAQQCNGIYIWKIGNEFEMLRRAETEEQKPVVIHSPGFYTGKHRYKLCMRLHLPLPTAQRCANYISLFVHTMQGEYDSHLPWPFQDTICLTILDQSQAPVRQNHEEIMDAKPELLAFQRPTIPRNPKGFGYVTFMHLEALRQRTFIKDDTLLVHCEVSTRFDMDSLQREGFQPQSTDAGV

SEQ ID NO: 25 - DNA, 1097 bp, Homo sapiens
agtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttctacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagacgctcatgtacctgtgctgcatcctcatgcttctcgcccccaccatggtcatctccagctcatacaccctcatcctgcatctcatccacaggatgaattctgccgccggccacaggaaggccttggccacctgctcctcccacatgatcatagtgctgctgctcttcggtgcttccttctacacctacatgctcccgagttcctaccacacagctgagcaggacatgatggtgtctgccttttacaccatcttcactcctgtgctgaaccccctcattcacagtctccgcaacaaagatgtcaccagggctctgaggagcatgatgcagtcaagaatgaaccaagaaaagtagtaaagggcaagcattgtcccctcctctttctataattccgttactccctatctctcctctcttttgccctcaggtctccgggtccccagcacaaagcccactcatattttccttctttcttatacgtggcgttttc

SEQ ID NO: 26 - protein, 318 aa, Homo sapiens
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFYLTLAGAEVFLLAAMAYDRYAAVCRPLHYPLLMNQRVCQLLVSACWVLGMVDGLLLTPITMSFPFCQSRKILSFFCETPALLKLSCSDVSLYKTLMYLCCILMLLAPTMVISSSYTLILHLIHRMNSAAGHRKALATCSSHMIIVLLLFGASFYTYMLPSSYHTAEQDMMVSAFYTIFTPVLNPLIHSLRNKDVTRALRSMMQSRMNQEK

SEQ ID NO: 27 - DNA, 1606 bp, Homo sapiens
atggctatgaaatggacttcagtccttctgttgatacagctgagctattactctagctctgggagttgtggaaatgtgccgctgtggcccatggaatatagtccttggatgaatataaagacaatcctggataaacttatgcagataagtcatgaggtgactgttctaacattgtcagcttccattcttgttgatcccaacataacatctgttactaaatttgaggtttattctatatctgtaattaaagatgattttgcagggttttttttcacacaacagattactaaatggatacatgatcttccaaaacatatattttggtttaaatgtgttcccttcaagaatattctttgggaatattctggttatactgagaagttctttaaagatgtagttttgaacaagaaacttatgacaaacctacaagaatcaaggtctgatgtcgttcatgcaaatgccattggtccctttggagagctgctggctgagctattaaaaatatcctttgtgtacagtctccacttctctcctggctacacatttgagaaatacagtggaggatttctacttccaccttcctatggagctgttattctgtcagaattaagtggttcgatgacattcatggagacagtaagaaatattatatatgtgttttattttgacttttggttccaaacatttgatatgaagaagggagaccagttttacagtgaagttctaggtaagtcatgttttttatctgagataatgggaaaagctgaaatgtggctcattcgaaactactggtatttggaatttcctcgcccactcttacctaattttgaatttgttgtaagactctactgcaaacctgtcaaccccctgcctaaggagaaaatggaagaatttgcccagagctctgatgaagacggtgttgtgttttctctggagtcagctgtgcaaaaccttacagaagaaaaagctgatcttatcacttcggccctggctcagattccacaaaaagtcatgaagttcggaaggaaaccaaataccttaagatccaatactcagtggcataggtggatcccacagaatgaatgtcttatcctagatcatccccaaaccaaagcctttataacttatggtggaacaaatagcatctatgagatgatctaccgtggagtcccttccatgggcattcctttgtttgcggaccaacatgataacattgctcacatgaaggccaagggagcagctgttatattggacttgagcacaaagtcaagtacagatttgctcgatatatctgtgttcgtatctttatttttatccttcagatataaagagagtgttatgaaattatcaagaattcaacatgatcaaccagtgaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgacatttatcatcacaaagtgttgtctgttttgtttctggaagtttactagaaaagtgaagaaggaaaaaagggattagttat

SEQ ID NO: 28 - protein, 533 aa, Homo sapiens
MAMKWTSVLLLIQLSYYSSSGSCGNVPLWPMEYSPWMNIKTILDKLMQISHEVTVLTLSASILVDPNITSVTKFEVYSISVIKDDFAGFFFTQQITKWIHDLPKHIFWFKCVPFKNILWEYSGYTEKFFKDVVLNKKLMTNLQESRSDVVHANAIGPFGELLAELLKISFVYSLHFSPGYTFEKYSGGFLLPPSYGAVILSELSGSMTFMETVRNIIYVFYFDFWFQTFDMKKGDQFYSEVLGKSCFLSEIMGKAEMWLIRNYWYLEFPRPLLPNFEFVVRLYCKPVNPLPKEKMEEFAQSSDEDGVVFSLESAVQNLTEEKADLITSALAQIPQKVMKFGRKPNTLRSNTQWHRWIPQNECLILDHPQTKAFITYGGTNSIYEMIYRGVPSMGIPLFADQHDNIAHMKAKGAAVILDLSTKSSTDLLDISVFVSLFLSFRYKESVMKLSRIQHDQPVKPLDRAVFWIEFVMRHKGAKHLRVAARDLTWFQYHSLDVIGFLLACVATVTFIITKCCLFCFWKFTRKVKKEKRD

SEQ ID NO: 29 - DNA, 1726 bp, Homo sapiens
agacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaagggctcccagggcgacattgcactcctccaactcagcagacccaccagctactcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctggggacccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 30 - protein, 307 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKGSQGDIALLQLSRPTSYSRYIRPICLPAANASFPNGLHCTVTGWGHVAPSVSLLTPKPLQQLEVPLISRETCNCLYNIDAKPEEPHFVQEDMVCAGYVEGGKDACQGDSGDPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 31 - DNA, 1161 bp, Homo sapiens
atggcccagaagggggtcctggggcctgggcagctgggggctgtggccattctgctctatcttggattactccggtcggggacaggagcggaaggggcagaagggaatgcccagattggtgtggtggaaacagacacagttgtggactccggaacaattgtgagactgggcagcatcggggagcatggtggaggttggggggtgctgggctcggaggcaatgcccaactcagccagcagaagcccgcctgtctacggaggggctgctgttccaatcaagcatccacaggcaaagggaagtttgccagacactccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggactctgcgggaggctggggccccatcttgatctttgagcccattcttctgggtgtgctttttgggaccatcactgagagtcaggagttttactgcctgtag

SEQ ID NO: 32 - protein, 386 aa, Homo sapiens
MAQKGVLGPGQLGAVAILLYLGLLRSGTGAEGAEGNAQIGVVETDTVVDSGTIVRLGSIGEHGGGWGVLGSEAMPNSASRSPPVYGGAAVPIKHPQAKGSLPDTPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKDSAGGWGPILIFEPILLGVLFGTITESQEFYCL

SEQ ID NO: 33 - DNA, 882 bp, Homo sapiens
agatctgcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccctctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcgtcgac

SEQ ID NO: 34 - DNA, 882 bp, Homo sapiens
agatctgcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcgtcgac

SEQ ID NO: 35 - DNA, 2940 bp, Homo sapiens
atggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaagagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctccccggttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagttaggggtcgctggcctctctatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagaaggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgaaaaactctccgaagaaaaacagattaagaaagaaggtgcatttccagtcacccagaaccgggcgctgcagctgctttatgatctgcgttacctcaacattgttctgacagccaagggtgacgaggtgaagagtagccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccgctggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaa

SEQ ID NO: 36 - protein, 979 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSPVPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAKGTGVLQEEMKLCSWFKHLPASIVEFQPTLRTLAHPISQEYLKDTLQKWIHMCNEDIKNGITNLLMYVKSMKGLAGIRDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQLGVAGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSSRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 37 - DNA, 1787 bp, Homo sapiens
cccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccagcaggtcccactggcctgttgttatctgttgcaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattg

SEQ ID NO: 38 - protein, 568 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQQVPLACCYLLQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 39 - DNA, 622 bp, Homo sapiens
ctcctttccaaagaaccatgagttcccacatcagccagaattactgcaccgaagtggaagccgccgtcagcagcctggtccaccggcagctgcgggcttcccttacctacctctctctcatcctccatttctaccgcgacgacgtgaccctggagggcatgggccacttccgagagctggcccaggagaagcgacagggcgcccagagtctgtggaagacgcaaaaccagcgcggagccctctgcgatgccatccagaagccgtcctgggatgaaaaggacagcagtttgggcgccctgcgagccgcgttggccctggagacgaacctgaaccaggccctgctggatctgcacgccctgggcgcaaagcatgcagactctcacccctgcggcttcctggagaaccacttccggccacatccctctgtcagacctgggaaagcgtccacccgagctgctcccttcaacctcaagatacattttttttctttctttctttttgaaagagtctccctgcgtgtagacccctggactattgattgcaccacattcattccttccccagctcactactccaacaaggtaccaaatataccaaatatttagagaattaggatgaacta

SEQ ID NO: 40 - protein, 201 aa, Homo sapiens
  VARIANT (196)..(196): Wherein Xaa is any amino acid as defined by the specification.
MSSHISQNYCTEVEAAVSSLVHRQLRASLTYLSLILHFYRDDVTLEGMGHFRELAQEKRQGAQSLWKTQNQRGALCDAIQKPSWDEKDSSLGALRAALALETNLNQALLDLHALGAKHADSHPCGFLENHFRPHPSVRPGKASTRAAPFNLKIHFFSFFLFERVSLRVDPWTIDCTTFIPSPAHYSNKVPNIPNIXRIRMN

SEQ ID NO: 41 - DNA, 781 bp, Homo sapiens
atttactattaatctacaagttgggtgttatgcaagtcctatatatggagtcccccaaacttctagagcaagggcttccccataatcctggcaggcaggcctcccctggggttcccaacttctgaccccactgaagtgtttatcctcttctctaatcccagcctccttttccctgtctccatgtgctctgagaggtgctctgagagatgctcccgctcccccagactccctctacatccccctcattttcttcctctccagtgtgtcaatggggtcctaaccccaccctcgacattgtcgccttttcctgatccaaagtgggaccttcttttcccccgagtggtcctgcctaggggtgccgctgccgggccccctctggtcttcctgctggagactggggcctttcgggagtcagcaggcgcccgggccaaccgcagccagcgaggggtgagcaatacttcactggcgagtcatcagggtgagctggccgtgtgtgatgcagtcactggctgggtgacagacccccggaccgctgtggactcaggtgtgctggaggtggaggtgttgggcgaggtgcctgcagctggcggcagttccctctgccaacacttctttgtcacctgcttcgaggccaataactctgaagaaggtggcccaggggtaggtggaggggctgccgcaggggtgtggaccggggggcactgggtgtctgagtgcaaggccaagcagtcctatgtgcgggcattgaccgctgatgcccagggctgtgtggactggtgat

SEQ ID NO: 42 - protein, 237 aa, Homo sapiens
SKGFPIILAGRPPLGFPTSDPTEVFILFSNPSLLFPVSMCSERCSERCSRSPRLPLHPPHFLPLQCVNGVLTPPSTLSPFPDPKWDLLFPRVVLPRGAAAGPPLVFLLETGAFRESAGARANRSQRGVSNTSLASHQGELAVCDAVTGWVTDPRTAVDSGVLEVEVLGEVPAAGGSSLCQHFFVTCFEANNSEEGGPGVGGGAAAGVWTGGHWVSECKAKQSYVRALTADAQGCVDW

SEQ ID NO: 43 - DNA, 1018 bp, Homo sapiens
ggcgcccagcggcttgcacctgttcgtccgaagaggttgtcataggattttctgatcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtcggcgcagttcgagcacacggttctgatcacgtcgaggggcgcgcagatcctgaccaaactaccccatgaggcctgaggagccgcccgaagg

SEQ ID NO: 44 - protein, 315 aa, Homo sapiens
SPLNHIYLHKQSSSQQRRNFFFRRQRDISHSIVLPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTISHITHQNGFQVCPHFVGHGIGSYFHGHPEIWHHANDSDLPMEEGMAFTIEPIITEGSPEFKVLEDAWTVVSLDNQRSAQFEHTVLITSRGAQILTKLPHEA

SEQ ID NO: 45 - DNA, 1018 bp, Homo sapiens; identical to SEQ ID NO: 43

SEQ ID NO: 46 - protein, 310 aa, Homo sapiens
IYLHKQSSSQQRRNFFFRRQRDISHSIVLPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTISHITHQNGFQVCPHFVGHGIGSYFHGHPEIWHHANDSDLPMEEGMAFTIEPIITEGSPEFKVLEDAWTVVSLDNQRSAQFEHTVLITSRGAQILTKLPHEA

SEQ ID NO: 47 - DNA, 1042 bp, Homo sapiens
gccacgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagtttcgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtcggcgcagttcgagcacacggttctgatcacgtcgaggggcgcgcagatcctgaccaaactaccccatgaggcctgaggagccgcccgaag

SEQ ID NO: 48 - protein, 335 aa, Homo sapiens
MAAPSGVHLLVRRGSHRIFSSPLNHIYLHKQSSSQQRRNFFFRRQRDISHSIVSPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTISHITHQNGFQVCPHFVGHGIGSYFHGHPEIWHHANDSDLPMEEGMAFTIEPIITEGSPEFKVLEDAWTVVSLDNQRSAQFEHTVLITSRGAQILTKLPHEA

SEQ ID NO: 49 - DNA, 1661 bp, Homo sapiens
cccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacgatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattg

SEQ ID NO: 50 - protein, 526 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 51 - protein, 730 aa, Homo sapiens [sequence omitted]

SEQ ID NO: 52 - protein, 2715 aa, Mus musculus
MDVKERRPYCSLTKSRREKERRYTNSSADNEECRVPTQKSYSSSETLKAFDHDYSRLLYGNRVKDLVHREADEYTRQGQNFTLRQLGVCESATRRGVAFCAEMGLPHRGYSISAGSDADTENEAVMSPEHAMRLWGRGVKSGRSSCLSSRSNSALTLTDTEHENRSDSESEQPSNNPGQPTLQPLPPSHKQHPAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWRCTALCAVGVSVLLAILLSYFIAMHLFGLNWHLQQTENDTFENGKVNSDTVPTNTVSLPSGDNGKLGGFTHENNTIDSGELDIGRRAIQEVPPGIFWRSQLFIDQPQFLKFNISLQKDALIGVYGRKGLPPSHTQYDFVELLDGSRLIAREQRNLVESERAGRQARSVSLHEAGFIQYLDSGIWHLAFYNDGKNPEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGENCEEADCLDPGCSNHGVCIHGECHCNPGWGGSNCEILKTMCADQCSGHGTYLQESGSCTCDPNWTGPDCSNEICSVDCGSHGVCMGGSCRCEEGWTGPACNQRACHPRCAEHGTCKDGKCECSQGWNGEHCTIAHYLDKIVKEGCPGLCNSNGRCTLDQNGWHCVCQPGWRGAGCDVAMETLCTDSKDNEGDGLIDCMDPDCCLQSSCQNQPYCRGLPDPQDIISQSLQTPSQQAAKSFYDRISFLIGSDSTHVLPGESPFNKSLASVIRGQVLTADGTPLIGVNVSFLHYSEYGYTITRQDGMFDLVANGGASLTLVFERSPFLTQYHTVWIPWNVFYVMDTLVMKKEENDIPSCDLSGFVRPSPIIVSSPLSTFFRSSPEDSPIIPETQVLHEETTIPGTDLKLSYLSSRAAGYKSVLKITMTQAVIPFNLMKVHLMVAVVGRLFQKWFPASPNLAYTFIWDKTDAYNQKVYGLSEAVVSVGYEYESCLDLTLWEKRTAVLQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAIDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLNAPSSLAASPDGTLYIADLGNIRIRAVSKNKPLLNSMNFYEVASPTDQELYIFDINGTHQYTVSLVTGDYLYNFSYSNDNDVTAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIFYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDSQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSSSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQTQYTAYGEIYFDSNVDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWEDVPPIFGVQQQVARQAKAFLSLGKMAEVQVSRRKAGAEQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGKR

SEQ ID NO: 53 - protein, 2515 aa, Drosophila melanogaster
MNFRKDLVARCSSPWFGIGSISVLFAFVVMLILLTTTGVIKWNQSPPCSVLVGNEASEVTAAKSTNTDLSKLHNSSVRAKNGQGIGLAQGQSGLGAAGVGSGGGSSAATVTTATSNSGTAQGLQSTSASAEATSSAATSSSQSSLTPSLSSSLANANNGGARTFPARSFPPDGTTFGQITLGQKLTKEIQPYSYWNMQFYQSEPAYVKFDYTIPRGASIGVYGRRNALPTHTQYHFKEVLSGFSASTRTARAAHLSITREVTRYMEPGHWFVSLYNDDGDVQELTFYAAVAEDMTQNCPNGCSGNGQCLLGHCQCNPGFGGDDCSESVCPVLCSQHGEYTNGECICNPGWKGKECSLRHDECEVADCSGHGHCVSGKCQCMRGYKGKFCEEVDCPHPNCSGHGFCADGTCICKKGWKGPDCATMDQDALQCLPDCSGHGTFDLDTQTCTCEAKWSGDDCSKELCDLDCGQHGRCEGDACACDPEWGGEYCNTRLCDVRCNEHGQCKNGTCLCVTGWNGKHCTIEGCPNSCAGHGQCRVSGEGQWECRCYEGWDGPDCGIALELNCGDSKDNDKDGLVDCEDPECCASHVCKTSQLCVSAPKPIDVLLRKQPPAITASFFERMKFLIDESSLQNYAKLETFNESRSAVIRGRVVTSLGMGLVGVRVSTTTLLEGFTLTRDDGWFDLMVNGGGAVTLQFGRAPFRPQSRIVQVPWNEVVIIDLVVMSMSEEKGLAVTTTHTCFAHDYDLMKPVVLASWKHGFQGACPDRSAILAESQVIQESLQIPGTGLNLVYHSSRAAGYLSTIKLQLTPDVIPTSLHLIHLRITIEGILFERIFEADPGIKFTYAWNRLNIYRQRVYGVTTAVVKVGYQYTDCTDIVWDIQTTKLSGHDMSISEVGGWNLDIHHRYNFHEGILQKGDGSNIYLRNKPRIILTTMGDGHQRPLECPDCDGQATKQRLLAPVALAAAPDGSLFVGDFNYIRRIMTDGSIRTVVKLNATRVSYRYHMALSPLDGTLYVSDPESHQIIRVRDTNDYSQPELNWEAVVGSGERCLPGDEAHCGDGALAKDAKLAYPKGIAISSDNILYFADGTNIRMVDRDGIVSTLIGNHMHKSHWKPIPCEGTLKLEEMHLRWPTELAVSPMDNTLHIIDDHMILRMTPDGRVRVISGRPLHCATASTAYDTDLATHATLVMPQSIAFGPLGELYVAESDSQRINRVRVIGTDGRIAPFAGAESKCNCLERGCDCFEAEHYLATSAKFNTIAALAVTPDSHVHIADQANYRIRSVMSSIPEASPSREYEIYAPDMQEIYIFNRFGQHVSTRNILTGETTYVFTYNVNTSNGKLSTVTDAAGNKVFLLRDYTSQVNSIENTKGQKCRLRMTRMKMLHELSTPDNYNVTYEYHGPTGLLRTKLDSTGRSYVYNYDEFGRLTSAVTPTGRVIELSFDLSVKGAQVKVSENAQKEMSLLIQGATVIVRNGAAESRTTVDMDGSTTSITPWGHNLQMEVAPYTILAEQSPLLGESYPVPAKQRTEIAGDLANRFEWRYFVRRQQPLQAGKQSKGPPRPVTEVGRKLRVNGDNVLTLEYDRETQSVVVMVDDKQELLNVTYDRTSRPISFRPQSGDYAYVDLEYDRFGRLVSWKWGVLQEAYSFDRNGRLNEIKYGDGSTMVYAFKDMFGSLPLKVTTPRRSDYLLQYDDAGALQSLTTPRGHIHAFSLQTSLGFFKYQYYSPINRHPFEILYNDEGQILAKIHPHQSGKVAFVHDTAGRLETILAGLSSTHYTYQDTTSLVKSVEVQEPGFELRREFKYHAGILKDEKLRFGSKNSLASARYKYAYDGNARLSGIEMAIDDKELPTTRYKYSQNLGQLEVVQDLKITRNAFNRTVIQDSAKQFFAIVDYDQHGRVKSVLMNVKNIDVFRLELDYDLRNRIKSQKTTFGRSTAFDKINYNADGHVVEVLGTNNWKYLFDENGNTVGVVDQGEKFNLGYDIGDRVIKVGDVEFNNYDARGFVVKRGEQKYRYNNRGQLIHSFERERFQSWYYYDDRSRLVAWHDNKGNTTQYYYANPRTPHLVTHVHFPKISRTMKLFYDDRDMLIALEHEDQRYYVATDQNGSPLAFFDQNGSIVKEMKRTPFGRIIKDTKPEFFVPIDFHGGLIDPHTKLVYTEQRQYDPHVGQWMTPLWETLATEMSHPTDVFIYRYHNNDPINPNKPQNYMIDLDSWLQLFGYDLNNMQSSRYTKLAQYTPQASIKSNTLAPDFGVISGLECIVEKTSEKFSDFDFVPKPLLKTEPKMRNLLPRVSYRRGVFGEGVLLSRIGGRALVSVVDGSNSVVQDVVSSVFNNSYFLDLHFSIHDQDVFYFVKDNVLKLRDDNEELRRLGGMFNISTHEISDHGGSAAKELRLHGPDAVVIIKYGVDPEQERHRILKHAHKRAVERAWELEKQLVAAGFQGRGDWTEEEKEELVQHGDVDGWNGIDIHSIHKYPQLADDPGNVAFQRDAKRKRRKTGSSHRSASNRRQLKFGELSA

SEQ ID NO: 54 - protein, 1045 aa, Homo sapiens
MDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 55 - protein, 964 aa, Homo sapiens
MTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 56 - protein, 140 aa, Homo sapiens
TSCCGFPTCSTLGTCGSSCCQPPSCCQPSCCQPVCSQTTCCRPTCFQSSCCRPSCCQTSCCQPTCCQSSSCQTGCGIGSCRTRWCRPDCRVEGTCLPPCCVVSCTPPTCCQPVSAQASCCRPSYCGQSCCRPACCCFPCT

SEQ ID NO: 57 - protein, 963 aa, Homo sapiens
LCSHLWQPGLGSCWSEGFPEAGSTHSRLCLLLCWTLIEAVGSRAKKEAAAEEAKVGWGCPALRPEVPLTLRARAISLMASSGRKLWLRYPSFLPAAWICLLPGWERLGRPRWGCQGQRLFQKCPLLPIRGFGWHLLVAWGAGSRGARLRAVEPQGSCPSAAMLTPAELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 58 - protein, 834 aa, Mus musculus
MAPHWAVWLLAAGLWGLGIGAEMWWNLVPRKTVSSGELVTVVRRFSQTGIQDFLTLTLTEHSGLLYVGAREALFAFSVEALELQGAISWEAPAEKKIECTQKGKSNQTECFNFIRFLQPYNSSHLYVCGTYAFQPKCTYINMLTFTLDRAEFEDGKGKCPYDPAKGHTGLLVDGELYSATLNNFLGTEPVILRYMGTHHSIKTEYLAFWLNEPHFVGSAFVPESVGSFTGDDDKIYFFFSERAVEYDCYSEQVVARVARVCKGDMGGARTLQKKWTTFLKARLVCSAPDWKVYFNQLKAVHTLRGASWHNTTFFGVFQARWGDMDLSAVCEYQLEQIQQVFEGPYKEYSEQAQKWARYTDPVPSPRPGSCINNWHRDNGYTSSLELPDNTLNFIKKHPLMEDQVKPRLGRPLLVKKNTNFTHVVADRVPGLDGATYTVLFIGTGDGWLLKAVSLGPWIHMVEELQVFDQEPVESLVLSQSKKVLFAGSRSQLVQLSLADCTKYRFCVDCVLARDPYCAWNVNTSRCVATTSGRSGSFLVQHVANLDTSKMCNQYGIKKVRSIPKNITVVSGTDLVLPCHLSSNLAHAHWTFGSQDLPAEQPGSFLYDTGLQALVVMAAQSRHSGPYRCYSEEQGTRLAAESYLVAVVAGSSVTLEARAPLENLGLVWLAVVALGAVCLVLLLLVLSLRRRLREELEKGAKASERTLVYPLELPKEPASPPFRPGPETDEKLWDPVGYYYSDGSLKIVPGHARCQPGGGPPSPPPGIPGQPLPSPTRLHLGGGRNSNANGYVRLQLGGEDRGGSGHPLPELADELRRKLQQRQPLPDSNPEESSV

SEQ ID NO: 59 - protein, 510 aa, Homo sapiens
MYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 60 - protein, 510 aa, Homo sapiens
MYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIDTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 61 - protein, 861 aa, Mus musculus
MRMCAPVRGLFLALVVVLRTAVAFAPVPRLTWEHGEVGLVQFHKPGIFNYSALLMSEDKDTLYVGAREAVFAVNALNISEKQHEVYWKVSEDKKSKCAEKGKSKQTECLNYIRVLQPLSSTSLYVCGTNAFQPTCDHLNLTSFKFLGKSEDGKGRCPFDPAHSYTSVMVGGELYSGTSYNFLGSEPIISRNSSHSPLRTEYAIPWLNEPSFVFADVIQKSPDGPEGEDDKVYFFFTEVSVEYEFVFKLMIPRVARVCKGDQGGLRTLQKKWTSFLKARLICSKPDSGLVFNILQDVFVLRAPGLKEPVFYAVFTPQLNNVGLSAVCAYTLATVEAVFSRGKYMQSATVEQSHTKWVRYNGPVPTPRPGACIDSEARAANYTSSLNLPDKTLQFVKDHPLMDDSVTPIDNRPKLIKKDVNYTQIVVDRTQALDGTFYDVMFISTDRGALHKAVILTKEVHVIEETQLFRDFEPVLTLLLSSKKGRKFVYAGSNSGVVQAPLAFCEKHGSCEDCVLARDPYCAWSPAIKACVTLHQEEASSRGWIQDMSGDTSSCLDKSKESFNQHFFKHGGTAELKCFQKSNLARVVWKFQNGELKAASPKYGFVGRKHLLIFNLSDGDSGVYQCLSEERVRNKTVSQLLAKHVLEVKMVPRTPPSPTSEDVQTEGSKITSKMPVGSTQGSSPPTPALWATSPRAATLPPKSSSGTSCEPKMVINTVPQLHSEKTVYLKSSDNRLLMSLLLFIFVLFLCLFSYNCYKGYLPGQCLKFRSALLLGKKTPKSDFSDLEQSVKETLVEPGSFSQQNGDHPKPALDTGYETEQDTITSKVPTDREDSQRIDELSARDKPFDVKCELKFADSDADGD

SEQ ID NO: 62 - protein, 420 aa, Homo sapiens
YVGARNRVYVLNLEDLSEVLNLKTGWPGSCETCEECNMKGKSPLTECTNFIRVLQAYNDTHLYVCGTNAFQPVCTLINLGDLFSLDVDNEEDGCGDCPYDPLGNTTSVLVQGGELYSGTVIDFSGRDPSIRRLLGSHDGLRTEFHDSKWLNLPNFVDSYPIHYVHSFSDDKVYFFFRETAVEDSNCKTIHSRVARVCKNDPGGRSYLELNKWTTFLKARLNCSIPGEGTPFYFNELQAAFVLPTGADTDPVLYGVFTTSSNSSAGSAVCAFSMSDINQVFEGPFKHQSPNSKWLPYRGKVPQPRPGQCPNASGLNLPDDTLNFIRCHPLMDEVVPPLHNVPLFVGQSGNYRLTSIAVDRVRAGDGQIYTVLFLGTDDGRVLKQVVLSRSSSASYLVVVLEESLVFPDGEPVQRMVISSKN

SEQ ID NO: 63 - protein, 417 aa, Homo sapiens
YVGARNRLYVLSLNLISEAEVKTGPVLSSPDCEECVSKGKDPPTDCVNFIRLLLDYNADHLLVCGTNAFQPVCRLINLGNLDRLEVGRESGRGRCPFDPQHNSTAVLVDGELYVGTVADFSGSDPAIYRSLSVRRLKGTSGPSLRTVLYDSRWLNEPNFVYAFESGDFVYFFFRETAVEDENCGKAVVSRVARVCKNDVGGPRSLSKKWTSFLKARLECSVPGEFPFYFNELQAAFLLPAGSESDDVLYGVFSTSSNPIPGSAVCAFSLSDINAVFNEPFKECETGNSQWLPYPRGLVPFPRPGTCPNTPLSSKDLPDDVLNFIKTHPLMDEVVQPLTGRPLFVKTDSNYLLTSIAVDRVRTDGGNYTVLFLGTSDGRILKVVLSRSSSSSESVVLEEISVFDPGSPVSDLVLSPKK

SEQ ID NO: 64 - protein, 592 aa, Mus musculus
MLKRLKKHVVAWKMCVMPHSRKMSVHMERPSPCGSWLVGCLFTIAVFQPPVQVLGDAGKVYIAPLRDTANLPCPLFLWPNMVLSEMRWYRPGHLPRTQAVHVFRDGQDRDEDLMPESKGRTALVRDAHKESYILQISNVRLEDRGLYQCQVWVGNSSREDNVTLQVAVLGSDPYIHVKGYDAGWIELLCQSVGWFPKPWTEWRDTAGRALLSLSEVHSLDENGLFRTAVSSRIRDNALGNVSCTIHIEALGQEKTTAMIIGAPERGSLSSPAVALSVVLPVLGLLILLGIWLICKQKKSKEKLLYEQAMEVESLLEDHAKEKGRLHKALKKLRSELKLKRAAANAGWRRARLHFVAVTLDPDTAHPKLILSEDRRCVRLGDRKRPVPDNPERFDFVVSVPGSEYFTTGCHYWEVYVGEKTKWILGVCSESVSRKGKVTASPANGHWLVRQSRGNEYEALTSPQTSFRLKESPKCVGIFLDYEAGIISFYNVTDKSHIFTFTHSFSSPLRPFFEPCLHDEGKNTAPLIICTELQKSEESIVPKQEGKDRANGDVSLKMNPSLLSPQGCELFLLNDTWPSNFGPALKGLKVPSL

SEQ ID NO: 65 - protein, 475 aa, Homo sapiens
MEMASSAGSWLSGCLIPLVFLRLSVHVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 66 - protein, 188 aa, Homo sapiens
FTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 67 - protein, 524 aa, Mus musculus
MAVPTNSCLLVCLLTLTVLQLPTLDSAAPFDVTAPQEPVLALVGSDAELTCGFSPNASSEYMELLWFRQTRSKAVLLYRDGQEQEGQQMTEYRGRATLATAGLLDGRATLLIRDVRVSDQGEYRCLFKDNDDFEEAAVYLKVAAVGSDPQISMTVQENGEMELECTSSGWYPEPQVQWRTGNREMLPSTSESKKHNEEGLFTVAVSMMIRDSSIKNMSCCIQNILLGQGKEVEISLPAPFVPRLTPWIVAVAIILLALGFLTIGSIFFTWKLYKERSSLRKKEFGSKERLLEELRCKKTVLHEVDVTLDPDTAHPHLFLYEDSKSVRLEDSRQILPDRPERFDSWPCVLGRETFTSGRHYWEVEVGDRTDWAIGVCRENVVKKGFDPMTPDNGFWAVELYGNGYWALTPLRTSLRLAGPPRRVGVFLDYDAGDISFYNMSNGSLIYTFPSISFSGPLRPFFCLWSCGKKPLTICSTANGPEKVTVIANVQDDIPLSPLGEGCTSGDKDTLHSKLIPFSPSQAAP

SEQ ID NO: 68 - protein, 524 aa, Mus musculus
MAVPTNSCLLVCLLTLTVLQLPTLDSAAPFDVTAPQEPVLALVGSDAELTCGFSPNASSEYMELLWFRQTRSTAVLLYRDGQEQEGQQMTEYRGRATLATAGLLDGRATLLIRDVRVSDQGEYRCLFKDNDDFEEAAVYLKVAAVGSDPQISMTVQENGEMELECTSSGWYPEPQVQWRTGNREMLPSTSESKKHNEEGLFTVAVSMMIRDSSIKNMSCCIQNILLGQGKEVEISLPAPFVPRLTPWIVAVAIILLALGFLTIGSIFFTWKLYKERSSLRKKEFGSKERLLEELRCKKTVLHEVDVTLDPDTAHPHLFLYEDSKSVRLEDSRQILPDRPERFDSWPCVLGRETFTSGRHYWEVEVGDRTDWAIGVCRENVVKKGFDPMTPDNGFWAVELYGNGYWALTPLRTSLRLAGPPRRVGVFLDYDAGDISFYNMSNGSLIYTFPSISFSGPLRPFFCLWSCGKKPLTICSTANGPEKVTVIANVQDDIPLSPLGEGCTSGDKDTLHSKLIPFSPSQAAP

SEQ ID NO: 69 - protein, 121 aa, Homo sapiens
GRHYFEVEVFTGGDKGHWRVGWATKSVPRGGFRLLGEDKGSWGYDGDGGKKYHNSEFPEYGLPFQEPGDVIGCFLDLEAGTISFYKNGKYLGLAFFDVTFSGPLYPAVSLGNGGSVRLNFG

SEQ ID NO: 70 - protein, 121 aa, Homo sapiens
SGKHYFEVEVDTGGEGHWRVGWATKSVRKPGESLLGDNEGSWGFDGSGGSKYHNGTGEDYGLPFQEGDVIGCFLDYEAGEISFTKNGKDLGIYAFRNVSFGGPLYPAVSLGSGEAVRFNFG

SEQ ID NO: 71 - protein, 78 aa, Homo sapiens
SVTLSCKASGFTFSSYYVSWVRQPPGKGLEWLGYIGSDVSYSEASYKGRVTISKDNSKNDVSLTISNLRVEDTGTYYC

SEQ ID NO: 72 - protein, 81 aa, Homo sapiens
TVKEGESVTLSCEASGNPPPTVTWYKQGGKLLAESGRFSVSRSGGNSTLTISNVTPEDSGTYTCAATNSSGSASSGTTLTV

SEQ ID NO: 73 - protein, 109 aa, Homo sapiens
MDSSPAGSRSRWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 74 - protein, 183 aa, Gallus gallus
MKVLTPAALILLFFFYTVDARTREYTSVITVPNGGHWGKWGIRQFCHSGYANGFALKVEPSQFGRDDTALNGIRLRCLDGSVIESLVGKWGTWTSFLVCPTGYLVSFSLRSEKSQGGGDDTAANNIQFRCSDEAVLVGDGLSWGRFGPWSKRCKICGLQTKVESPQGLRDDTALNNVRFFCCK

SEQ ID NO: 75 - protein, 163 aa, Gallus gallus [sequence omitted]

SEQ ID NO: 76 - protein, 200 aa, Cyprinus carpio
MISLLVITGLQGSVEARRRRIKRSSDRYYRSELTVPNGGGWGSWGQREMCPAGTYAAGFSLRVEDPVGREDDTALNGIRLHCIESKASSDSYHSYSTGQSDVFSWGRWTDIKWCPSGFLTAFQLRVERSQGDGDDTAANNILFRCSQGTLQGDGTNWGDWGTWSLTCEGKGICGLKTRIEVPQGRDDDTSLNDVIMYCCD

SEQ ID NO: 77 - protein, 360 aa, Caenorhabditis elegans
MKCGAKLNLSEFSINTEPLLTISSEMIVLITLLLFAIPILCNKVELRSPRVTTFGDWNSWARCRDGEFAYAIQVKVEGKQGSRGDDTGLNAVALYCRPLGSDAISRNNKIMSGEAPWGGWGGIKYCPNNKVLIGFTLRSEQNQRDGDDCAADNFAGYCGTPHGPRNRDSRIQGDGTGWGDWTDDQWCPEGYAVCGIQSQIEKEQGRGDDTAVNNVDLECCQVGVSSCNPGYSLVRIGEYDNRRGAGTVTKEFQQRVSITKTSGVTTTLSNSEKYSVSKAIEAGISATHGMFTAKVNTALTKTSERITTSQLQRMIQDATTHERIEKITFTVPAWHRVIVEQLIITCGGYEVGIAKTISRS

SEQ ID NO: 78 - protein, 1583 aa, Homo sapiens
LLPHLPPCRRRRVMSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 79 - protein, 2092 aa, Homo sapiens
MAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 80 - protein, 1308 aa, Homo sapiens
DESSLLRRRGLQKELSLPRRGRGCRSGNRKSLVVGTPSPTLSRPLSPLSVPTAGSSPLDSPRNFSAASALNFPFARRADGRRWSLASLPSSGYGTNTPSSTLSSSSSSRERLHQLPFQPTPDELHFLSKHFRSSENVLDEEGGRSPRLRPRSRSLSPGRATGTFDNEIVMMNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDAGRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 81 - protein, 2137 aa, Homo sapiens
EFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLEPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 82 - protein, 1734 aa, Mus musculus
MVTGLSPLLFRKLSNPDIFAPTGKVKLQRQLSQDDCKLRRGSLASSLSGKQLLPLSSSVHSSVGQVTWQSTGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTENVPDEEGRRSPRMRPRSRSLSPGRSPVSFDSEIIMMNHVYKERFPKATAQMEERPSLTFISSNTPDSVLPLADGALSFIHHQVIEMARDCLDKSRSGLITSHYFYELQENLEKLLQDAHERSESSDVAFVIQLVKKLMIIIARPARLLECLEFDPEEFYHLLEAAEGHAKEGHGIKCDIPRYIVSQLGLTRDPLEEMAQLSSYDSPDTPETDDSVEGRGVSQPSQKTPSEEDFETIKLISNGAYGAVFLVRHKSTRQRFAMKKINKQNLILRNQIQQAFVERDILTFAENPFVVSMFCSFETKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDDALPPDAQDLTSKLLHQNPLERLGTSSAYEVKQHPFFMGLDWTGLLRQKAEFIPQLESEDDTSYFDTRSERYHHVDSEDEEEVSEDGCLEIRQFSSCSPRFSKVYSSMERLSLLEERRTPPPTKRSLSEEKEDHSDGLAGLKGRDRSWVIGSPEILRKRLSVSESSHTESDSSPPMTVRHRCSGLPDGPHCPEETSSTPRKQQQEGIWVLIPPSGEGSSRPVPERPLERQLKLDEEPPGQSSRCCPALETRGRGTPQLAEEATAKAISDLAVRRARHRLLSGDSIEKRTTRPVNKVIKSASATALSLLIPSEHHACSPLASPMSPHSQSSNPSSRDSSPSRDFLPALGSLRPPIIIHRAGKKYGFTLRAIRVYMGDTDVYTVHHMVWHVEDGGPASEAGLRQGDLITHVNGEPVHGLVHTEVVELVLKSGNKVSISTTPLENTSIKVGPARKGSYKAKMARRSKRSKGKDGQESRKRSSLFRKITKQASLLHTSRSLSSLNRSLSSGESGPGSPTHSHSLSPRSPPQGYRVAPDAVHSVGGNSSQSSSPSSSVPSSPAGSGHTRPSSLHGLAPKLQRQYRSPRRKSAGSIPLSPLAHTPSPPATAASPQRSPSPLSGHGSQSFPTKLHLSPPLGRQLSRPKSAEPPRSPLLKRVQSAEKLAAALAAAEKKLAPSRKHSLDLPHGELKKELTPREASPLEVVGTRSVLSGKGPLPGKGVLQPAPSRALGTLRQDRAERRESLQKQEAIREVDSSEDDTDEEPENSQATQEPRLSPHPEASHNLLPKGSGEGTEEDTFLHRDLKKQGPVLSGLVTGATLGSPRVDVPGLSPRKVSRPQAFEEATNPLQVPSLSRSGPTSPTPSEGCWKAQHLHTQALTALCPSFSELTPTGCSAATSTSGKPGTWSWKFLIEGPDRASTNKTITRKGEPANSQDTNTTVPNLLKNLSPEEEKPQPPSVPGLTHPLLEVPSQNWPWESECEQMEKEEPSLSITEVPDSSGDRRQDIPCRAHPLSPETRPSLLWKSQELGGQQDHQDLALTSDELLKQT

SEQ ID NO: 83 - protein, 256 aa, Homo sapiens
YELLEVLGKGAFGKVYLARDKKTGKLVAIKVIKKEKLKKKKRERILREIKILKKLDHPNIVKLYDVFEDDDKLYLVMEYCEGGDLFDLLKKRGRLSEDEARFYARQILSALEYLHSQGIIHRDLKPENILLDSDGHVKLADFGLAKQLDSGGTLLTTFVGTPEYMAPEVLLGKGYGKAVDIWSLGVILYELLTGKPPFPGDDQLLALFKKIGKPPPPFPPPEWKISPEAKDLIKKLLVKDPEKRLTAEEALEHPFF

SEQ ID NO: 84 - protein, 256 aa, Homo sapiens
YELGEKLGSGAFGKVYKGKHKDTGEIVAIKILKKRSLSEKKKRFLREIQILRRLSHPNIVRLLGVFEEDDHLYLVMEYMEGGDLFDYLRRNGLLLSEKEAKKIALQILRGLEYLHSRGIVHRDLKPENILLDENGTVKIADFGLARKLESSSYEKLTTFVGTPEYMAPEVLEGRGYSSKVDVWSLGVILYELLTGKLPFPGIDPLEELFRIKERPRLRLPLPPNCSEELKDLIKKCLNKDPEKRPTAKEILNHPWF

SEQ ID NO: 85 - protein, 244 aa, Homo sapiens
KKLGEGAFGEVYKGTLKGKGGVEVEVAVKTLKEDASEQQIEEFLREARLMRKLDHPNIVKLLGVCTEEEPLMIVMEYMEGGDLLDYLRKNRPKELSLSDLLSFALQIARGMEYLESKNFVHRDLAARNCLVGENKTVKIADFGLARDLYDDDYYRKKKSPRLPIRWMAPESLKDGKFTSKSDVWSFGVLLWEIFTLGESPYPGMSNEEVLEYLKKGYRLPQPPNCPDEIYDLMLQCWAEDPEDR

SEQ ID NO: 86 - protein, 77 aa, Homo sapiens
VELEKGGGGLGFSLVGGKDSGDGGVVVSSVVPGSPAAKAGLKPGDVILEVNGTSVEGLTHLEAVDLLKEAGGKVTLT

SEQ ID NO: 87 - protein, 78 aa, Homo sapiens
VTLERQGRGGLGFSLKGGSDKGDQGIVVSEVLPGGAAERGGLKEGDRILEINGQDVENVTHERAVLALKGSGGEVTLT

SEQ ID NO: 88 - protein, 348 aa, Rattus norvegicus
MVLLAQGACCSNQWLAAVLLSLCSCLPAGQSVDFPWAAVDNMLVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTINEGTNVTLTCLATGKPEPAISWRHISPSAKPFENGQYLDIYGITRDQAGEYECSAENDVSFPDVKKVRVVVNFAPTIQEIKSGTVTPGRSGLIRCEGAGVPPPAFEWYKGEKRLFNGQQGIIIQNFSTRSILTVTNVTQEHFGNYTCVAANKLGTTNASLPLNPPSTAQYGITGSACDLFSCWSLALTLSSVISIFYLKNAILQ

SEQ ID NO: 89 - protein, 352 aa, Gallus gallus
MVPLVRGAGGSHQWLAAVLLGLCCLLPAGRLAAPGGDFPGAAADSLVVRKGDTAVLRCYLEDGASKGAWLNRSSIIFAGSDKWSVDPRVSIATANRREYSLQIQDVDVTDDGPYTCSVQTQHTPRTMQVHLTVQVSPKIFRISSDIVVNEGSNVTLVCLATGKPEPSISWRHISPSAKPFESGQYLDIYGITRDQAGEYECSAENDVSVPDVKKVKVTVNFAPTIQELKSSGVMLGGNGLIRCEGAGVPAPVFEWYRGERKLISGQQGITIKNYSTRSLLTVTNVTEEHFGNYTCVAANKLGMTNASLPLNPPSTAQYGITGDAEVLFSCWYLVLTLSSLTSIFYLKNIILH

SEQ ID NO: 90 - protein, 261 aa, Gallus gallus
MVPLVRGAGGSHQWLAAVLLGLCCLLPAGRLAAPGGDFPGAAADSLVVRKGDTAVLRCYLEDGASKGAWLNRSSIIFAGSDKWSVDPRVSIATANRREYSLQIQDVDVTDDGPYTCSVQTQHTPRTMQVHLTVQVSPKIFRISSDIVVNEGSNVTLVCLATGKPEPSISWRHISPSAKPFESGQYLDIYVITRDQAGEYECSAENDVSVPDVKKVKVTVNSPSTAQYGITGDAEVLFSCWYLVLTLSSLTSIFYLKNIILH

SEQ ID NO: 91 - protein, 338 aa, Rattus norvegicus
MVGRVQPDRKQLPLVLLRLLCLLPTGLPVRSVDFNRGTDNITVRQGDTAILRCVVEDKNSKVAWLNRSGIIFAGHDKWSLDPRVELEKRHALEYSLRIQKVDVYDEGSYTCSVQTQHEPKTSQVYLIVQVPPKISNISSDVTVNEGSNVTLVCMANGRPEPVITWRHLTPLGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLFCLLSKC

SEQ ID NO: 92 - protein, 338 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 93 - protein, 82 aa, Homo sapiens
PSVTVKEGESVTLSCEASGNPPPTVTWYKQGGKLLAESGRFSVSRSGGNSTLTISNVTPEDSGTYTCAATNSSGSASSGTTL

SEQ ID NO: 94 - protein, 63 aa, Homo sapiens
LEGESVTLTCPASGDPVPNITWLKDGKPLPESRVVASGSTLTIKNVSLEDSGLYTCVARNSVG

SEQ ID NO: 95 - protein, 1066 aa, Homo sapiens
PLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 96 - protein, 922 aa, Homo sapiens
MLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 97 - protein, 954 aa, Homo sapiens [sequence omitted]

SEQ ID NO: 98 - protein, 953 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRAVLKLREGSSHISLPSGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 99 - protein, 394 aa, Homo sapiens [sequence omitted]

SEQ ID NO: 100 - protein, 258 aa, Homo sapiens
LTLGKKLGEGAFGEVYKGTLKGKGGVEVEVAVKTLKEDASEQQIEEFLREARLMRKLDHPNIVKLLGVCTEEEPLMIVMEYMEGGDLLDYLRKNRPKELSLSDLLSFALQIARGMEYLESKNFVHRDLAARNCLVGENKTVKIADFGLARDLYDDDYYRKKKSPRLPIRWMAPESLKDGKFTSKSDVWSFGVLLWEIFTLGESPYPGMSNEEVLEYLKKGYRLPQPPNCPDEIYDLMLQCWAEDPEDRPTFSELVERL

SEQ ID NO: 101 - protein, 251 aa, Homo sapiens
YELGEKLGSGAFGKVYKGKHKDTGEIVAIKILKKRSLSEKKKRFLREIQILRRLSHPNIVRLLGVFEEDDHLYLVMEYMEGGDLFDYLRRNGLLLSEKEAKKIALQILRGLEYLHSRGIVHRDLKPENILLDENGTVKIADFGLARKLESSSYEKLTTFVGTPEYMAPEVLEGRGYSSKVDVWSLGVILYELLTGKLPFPGIDPLEELFRIKERPRLRLPLPPNCSEELKDLIKKCLNKDPEKRPTAKEIL

SEQ ID NO: 102 - protein, 250 aa, Homo sapiens
ELLEVLGKGAFGKVYLARDKKTGKLVAIKVIKKEKLKKKKRERILREIKILKKLDHPNIVKLYDVFEDDDKLYLVMEYCEGGDLFDLLKKRGRLSEDEARFYARQILSALEYLHSQGIIHRDLKPENILLDSDGHVKLADFGLAKQLDSGGTLLTTFVGTPEYMAPEVLLGKGYGKAVDIWSLGVILYELLTGKPPFPGDDQLLALFKKIGKPPPPFPPPEWKISPEAKDLIKKLLVKDPEKRLTAEEAL

SEQ ID NO: 103 - protein, 57 aa, Homo sapiens
EGPQVRALYDYTAQDPDELSFKKGDIITVLEKSDDGWWKGRLGTGKEGLFPSNYVEE

SEQ ID NO: 104 - protein, 56 aa, Homo sapiens
PKVVALYDYQARESDELSFKKGDIIIVLEKSDDGGWWKGRLKGTKEGLIPSNYVEP

SEQ ID NO: 105 - protein, 204 aa, Homo sapiens; identical to SEQ ID NO: 18

SEQ ID NO: 106 - protein, 102 aa, Mus musculus
MPTSAVVVPATGPAPHSAGAGLLRISVKEVVFGSLTAALVLATVLLTLRAWRRGICPTGPCCYPAPHYAPARQDQECQVSMLPAGFPLSPDLPPEPGKTTAL

SEQ ID NO: 107 - protein, 722 aa, Mus musculus
MGRRSALALAVVSALLCQVWSSGVFELKLQEFVNKKGLLGNRNCCRGGSGPPCACRTFFRVCLKHYQASVSPEPPCTYGSAVTPVLGVDSFSLPDGAGIDPAFSNPIRFPFGFTWPGTFSLIIEALHTDSPDDLATENPERLISRLTTQRHLTVGEEWSQDLHSSGRTDLRYSYRFVCDEHYYGEGCSVFCRPRDDAFGHFTCGDRGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCKNGASCTDLEDSFSCTCPPGFYGKVCELSAMTCADGPCFNGGRCSDNPDGGYTCHCPLGFSGFNCEKKMDLCGSSPCSNGAKCVDLGNSYLCRCQAGFSGRYCEDNVDDCASSPCANGGTCRDSVNDFSCTCPPGYTGKNCSAPVSRCEHAPCHNGATCHQRGQRYMCECAQGYGGPNCQFLLPEPPPGPMVVDLSERHMESQGGPFPWVAVCAGVVLVLLLLLGCAAVVVCVRLKLQKHQPPPEPCGGETETMNNLANCQREKDVSVSIIGATQIKNTNKKADFHGDHGAKKSSFKVRYPTVDYNLVRDLKGDEATVRDTHSKRDTKCQSQSSAGEEKIAPTLRGGEIPDRKRPESVYSTSKDTKYQSVYVLSAEKDECVIATEV

SEQ ID NO: 108 - protein, 714 aa, Rattus norvegicus
MGRRSALALAVVSALLCQVWSSGVFELKLQEFVNKKGLLGNRNCCRGGSGPPCACRTFFRVCLKHYQASVSPEPPCTYGSAVTAVLGVDSFSLPDGAGIDPAFSNPIRFPFGFTWPGTFSLIIEALHTDSPDDLATENPERLISRLTTQRHLTVGEEWSQDLHSSGRTDLRYSYRFVCDEHYYGEGCSVFCRPRDDAFGHFTCGERGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCRNGGSCTDLEDSYSCTCPPGFYGKVCELSAMTCADGPCFNGGRCSDNPDGGYTCHCPAGFSGFNCEKKIDLCSSSPCSNGAKCVDLGNSYLCRCQTGFSGRYCEDNVDDCASSPCANGGTCRDSVNDFSCTCPPGYTGRNCSAPVSRCEHAPCHNGATCHQRGQRYMCECAQGYGGANCQFLLPEPPPDLIVAAQGGSFPWVAVCAGVVLVLLLLLGCAAVVVCVRLKLQKHQPPPDPCGGETETMNNLANCQREKDVSVSIIGATQIKNTNKKADFHGDHGADKSSFKARYPTVDYNLIRDLKGDEATVRDAHSKRDTKCQSQGSVGEEKSTSTLRGGEVPDRKRPESVYSTSKDTKYQSVYVLSAEKDECVIATEV

SEQ ID NO: 109 - protein, 721 aa, Xenopus laevis
MGQQRMLTLLVLSAVLCQISCSGLFELRLQEFVNKKGLLGNMNCCRPGSLASLQRCECKTFFRICLKHYQSNVSPEPPCTYGGAVTPVLGTNSFVVPESSNADPTFSNPIRFPFGFTWPGTFSLIIEAIHADSADDLNTENPERLISRLATQRHLTVGEQWSQDLHSSDRTELKYSYRFVCDEYYYGEGCSDYCRPRDDAFGHFSCGEKGEKLCNPGWKGLYCTEPICLPGCDEHHGYCDKPGECKCRVGWQGRYCDECIRYPGCLHGTCQQPWQCNCQEGWGGLFCNQDLNYCTHHKPCENGATCTNTGQGSYTCSCRPGYTGSNCEIEVNECDANPCKNGGSCSDLENSYTCSCPPGFYGKNCELSAMTCADGPCFNGGRCADNPDGGYICFCPVGYSGFNCEKKIDYCSSNPCANGARCEDLGNSYICQCQEGFSGRNCDDNLDDCTSFPCQNGGTCQDGINDYSCTCPPGYIGKNCSMPITKCEHNPCHNGATCHERNNRYVCQCARGYGGNNCQFLLPEEKPVVVDLTEKYTEGQSGQFPWIAVCAGIVLVLMLLLGCAAVVVCVRVRVQKRRHQPEACRGESKTMNNLANCQREKDISVSFIGTTQIKNTNKKIDFLSESNNEKNGYKPRYPSVDYNLVHELKNEDSPKEERSKCEAKCSSNDSDSEDVNSVHSKRDSSERRRPDSAYSTSKDTKYQSVYVISDEKDECIIATEV

SEQ ID NO: 110 - protein, 28 aa, Homo sapiens
PCSNGGTCVNTPGGYTCICPPGYTGKRC

SEQ ID NO: 111 - protein, 1275 aa, Homo sapiens [sequence omitted]

SEQ ID NO: 112 - protein, 1244 aa, Rattus norvegicus
MQKAIRLNDGHVVSLGLLAQRDGTRKGYLSKRSSDNPKWQTKWFALLQNLLFYFESDSSSRPSGLYLLEGSICKRMPSPKRGTSSKESDKQHHYFTVNFSNDSQKSLELRTDDSKDCDEWVAAIARASYKILATQHQALMQKYLHLLQVVETEKTVAKQLRQQLEDGEVEIERLKAEIANLIKDNERIQSNQLVAPEDEDSDIKKIKKVQSFLRGWLCRRKWKNIIQDYIRSPHADSMRKRNQVVFSMLEAEAEYVQQLHILVNNFLRPLRMAASSKKPPITHDDVSSIFLNSETIMFLHQIFYQGLKARIASWPTLVLADLFDILLPMLNIYQEFVRNHQYSLQILAHCKQNRDFDKLLKQYEAKPDCEERTLETFLTYPMFQIPRYILTLHELLAHTPHEHVERNSLDYAKSKLEELSRVMHDEVSETENIRKNLAIERMITEGCEILLDTSQTFVRQGSLIQVPMSEKGKINKGRLGSLSLKKEGERQCFLFSKHLIICTRGSGSKLHLTKNGVISLIDCTLLDDPENMDDDGKGQEVDHLDFKIWVEPKDSPPFTVILVASSRQEKAAWTSDIIQCVDNIRCNGLMMNAFEENSKVTVPQMIKSDASLYCDDVDIRFSKTMNSCKVLQIRYASVERLLERLTDLRFLSIDFLNTFLHSYRVFTDAVVVLDKLISIYKKPITAIPARSLELLFSSSHNTKLLYGDAPKSPRASRKFSSPPPLAIGTSSPVRRRKLSLNIPIITGGKALELASLGCPSDGYTNIHSPISPFGKTTLDTSKLCVASSLTRTPEEIDMTTLEESSGFRKPTSDILKEESDDDQSDVDDTEVSPPTPKSFRNRITQEFPLFNYNSGIMMTCRDLMDSNRSPLSATSAFAIATAGANESPANKEIYRRMSLANTGYSSDQRNIDKEFVIRRAATNRVLNVLRHWVTKHSQDFETDDLLKYKVICFLEEVMHDPDLLPQERKAAANIMRTLTQEEITENHSMLDELLLMTEGVKTEPFENHSAMEIAEQLTLLDHLVFKSIPYEEFFGQGWMKADKNERTPYIMKTTRHFNHISNLIASEILRNEEVSARASTIEKWVAVADICRCLHNYNAVLEITSSINRSAIFRLKKTWLKVSKQTKSLFDKLQKLVSSDGRFKNLRETLRNCDPPCVPYLGMYLTDLAFLEEGTPNYTEDGLVNFSKMRMISHIIREIRQFQQTTYKIEPQPKVTQYLVDETFVLDDESLYEASLRIEPKLPT

SEQ ID NO: 113 - protein, 1237 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDRAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKNCNPPAVPYLGMYLTDLAFIEEGTPNFTEEGLVNFSKMRMISHIIREIRQFQQTSYRIDHQPKVAQYLLDKDLIIDEDTLYELSLKIEPRLPA

SEQ ID NO: 114 - protein, 1262 aa, Mus musculus
MQKAIRLNDGHVVTLGLLAQKDGTRKGYLSKRSADNPKWQTKWFALLQNLLFYFESDSSPRPSGLYLLEGSICKRAPSPKRGTSSKESGEKQQHYFTVNFSNDSQKTLELRTEDAKDCDEWVAAIARASYKILATEHEALMQKYLHLLQVVETEKTVAKQLRQQLEDGEVEIERLKTEVTITNLIKDNDRIQSSNKAGSADDEDSDIKKIKKVQSFLRGWLCRRKWKNIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKQYEAKPDCEERTLETFLTYPMFQIPRYILTLHELLAHTPHEHVERNSLDYAKSKLEELSRIMHDEVSETENIRKNLAIERMITEGCEILLDTSQTFVRQGSLMQMSLSEKSKSSRGRLGSLSTKKEGERQCFLFSKHLIICTRGSGGKLHLTKNGVISLIDCTLLDEPENLDDEAKGAGPEIEHLEFKIGVEPKDSLPFTVILVASTRQEKAAWTSDIIQCVDNIRCNGLMMNAFEENSKVTVPQMIKSDASLYCDDVDIRFSKTMNSCKVLQIRYASVERLLERLTDLRFLSIDFLNTFLHSYRVFTNAMVVLDKLINIYRKPMSAIPARSLELLFSSSHNAKLLYGDAPKSPRASRKFSSPPPLAIGTSSPSRRRKLSLNIPIITGGKALELASLGCSSDSYANIHSPISPFGKTTLDTGKLCMASSLPKTPEEIDVPATIPEKPGELSASRKHSSDVLKEESEDDQNHSDEDNTEVSPVKSPPTPKSFLNRTITEFPFFNYNNGILMTTCRDLVDNNRSTLSATSAFAIATAGANEGPSNKEVFRRMSLANTGFSSDQRNIDKEFVIRRAATNRVLNVLRHWVTKHTQDFDTDDTLKYRVICFLEEVMHDPDLLTQERKAAANIIRTLTLEETTEQHSMLEEVILMTEGVKTEPFENHPALEIAEQLTLLDHLVFKSIPYEEFFGQGWMKAEKYERTPYIMKTTKHFNHVSNFIASEIIRNEDISARASAIEKWVAVADICRCLHNYNAVLEITSSINRSAIFRLKKTWLKVSKQTKSLLDKLQKLVSSDGRFKNLRESLRNCDPPCVPYLGMYLTDLVFIEEGTPNYTEDGLVNFSKMRMISHIIREIRQFQQTTYKIDPQPKVIQYLLDESFMLDEESLYESSLLIEPKLPT

SEQ ID NO: 115 - protein, 1189 aa, Mus musculus
MQKSVRYNEGHALYLAMLARKEGTKRGFLSKKAAEASRWHEKWFALYQNVLFYFEGEQSGRPAGMYLLEGCSCERTPAPPRTNAGPAGARDALDKQYYFTVLFGHDGQKPLELRCEEEQAGKEWMEAIHQASYADILIEREVLMQKYIHLVQIVETEKIATNQLRHQLEDQDTEIERLKSEIVALNKTKERMRPYHVHQEEEDPDIKKIKKVQSFMRGWLCRRKWKTIVQDYICSPHAESMRKRNQIVFTMVEAETEYVHQLYILVNGFLRPLGMAASSKKPPINHDDVSSIFLNSETIMFLHEIFHQGLKARLANWPTLVLADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIQCTLIEEPDGSDDDPKGSGHMFGHLDFKIVVEPPDAASFTVVLLAPSRQEKAAWMSDISQCVDNIRCNGLMTIVFEENSKVTVPHMIKSDARLHKDDTDICFSKTLNSCKVPQIRYASVEALLERLTDLRFLSIDFLNTFLHTYRIFTTATVVLAKLSDIYKRPFTSIPVRSLELFFATSQNKREHLVDGKSPRLCRKFSSPPPLAVSRTSSPVRARKLSLTSSLNSRIGALDLTNSSSSSSPTTTTHSPAASPPPHTAVLESAPADKAGDSADMSPCRSPTTPRASAIGRPGGQVADSAHCSVSPASAFAIATAAAGHGSPPGFNNERTCDKEFIIRRTATNRVLNVLRHWVSKHAQDFELNNELKMNVLNLLEEVLRDPDLLPQERKATANILRALSQDDQDDIHLKLEDIIQMTDCPKAECFETLSAMELAEQITLLDHIVFRSIPYEEFLGQGWMKLDKNERTPYIMKTSQHFNEMSNLVASQIMNYADISSRPNAIEKWVAVADICRCLHNYNGVLEITSALNRSPIYRLKKTWAKVSKQTKALMDKLQKTVSSEGRFKNLRETLKNCNPPAVPYLGMYLTDLAFIEEGTPNFTEEGLVNFSKMRMISHIIREIRQFQQTAYRIDQQPKVIQYLLDKALVIDEDSLYELSLKIEPRLPA

SEQ ID NO: 116 - protein, 241 aa, Homo sapiens
LLLLDPKELAEQLTLLDFELFRKIDPSELLGSVWGKRSKKSPSPLNLERFIERFNEVSNWVATEILKQTTPKDRAELLSKFIQVAKHCRELNNFNSLMAIVSALSSSPISRLKKTWEKLPSKYKKLFEELEELLDPSRNFKNYREALSSCNLPPCIPFLGVLLKDLTFIDEGNPDFLKNGLVNFEKRRKIAKILREIRQLQSQPYNLRPNRSDIQSLLQQSLDSLPEENELYELSLRIEPR

SEQ ID NO: 117 - protein, 187 aa, Homo sapiens
LLDPLELAKQLTLLEHELFKKIDPFECLGQVWGKKYGKNERSPNIDKTIKNFNQLTNFVGTTILLQTDPKKRAELIQKFIQVADHCRELNNFNSLLAIISALYSSPIYRLKKTWQYVPPQSLKLFEELNKLMDSDRNFSNYRELLKSIFPLPCVPFFGVYLSDLTFLEEGNPDFLETNLVNFSKRRK

SEQ ID NO: 118 - protein, 182 aa, Homo sapiens
VLKELLETEKKYVRDLEILVNVYMKPLREAAISKPVLTPDDLETIFSNINEIYEFHREFLKSLEDRISSSPSAPRLGDLFLKLEPFLQIYGEYCANKPYAQELLEKCSSNPQFAEFLDEVEASSNTGKLTLQSLLLKPVQRIPRYPLLLKELLKHTPEDQPDREDLKKALDLLQDLAKSINE

SEQ ID NO: 119 - protein, 181 aa, Homo sapiens
VLKELLQTERNYVRDLKILVEVFLKPLKKEAKLLSPDEVETLFGNIEEIYEFHRIFLDELEKRVEEWDDSGDRIGDVFLKLEELFKIYSEYCSNHPDALELLKKLKKKNKRFQKFLKEIESNPNCRRLELESLLLKPVQRLTKYPLLLKELLKHTPPDHEDREDLKKALDAIKELASQVNE

SEQ ID NO: 120 - protein, 54 aa, Homo sapiens
YDKVGSIKGGTLEALIEYLTDLESEDLFFVETFLLTYRSFITTQELLDLLISRY

SEQ ID NO: 121 - protein, 102 aa, Homo sapiens
IKEGWLLKKSSGGKKSWKKRYFVLFNGVLLYYKSKKKKSSSKPKGSIPLSGCTVREAPDSDSDKKKNCFEIVTPDRKTLLLQAESEEERKEWVEALRKAIAK

SEQ ID NO: 122 - protein, 155 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 123 - protein, 155 aa, Mus musculus
MVLSGALCFRMKDSALKVLYLHNNQLLAGGLHAEKVIKGEEISVVPNRALDASLSPVILGVQGGSQCLSCGTEKGPILKLEPVNIMELYLGAKESKSFTFYRRDMGLTSSFESAAYPGWFLCTSPEADQPVRLTQIPEDPAWDAPITDFYFQQCD

SEQ ID NO: 124 - protein, 156 aa, Mus musculus
MMVLSGALCFRMKDSALKVLYLHNNQLLAGGLHAEKVIKGEEISVVPNRALDASLSPVILGVQGGSQCLSCGTEKGPILKLEPVNIMELYLGAKESKSFTFYRRDMGLTSSFESAAYPGWFLCTSPEADQPVRLTQIPEDPAWDAPITDFYFQQCD

SEQ ID NO: 125 - protein, 152 aa, Homo sapiens
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 126 - protein, 152 aa, Homo sapiens [sequence omitted]

SEQ ID NO: 127 - protein, 143 aa, Homo sapiens
FRLNDANQKSLVLANPQYLKALHLQGQNLNQEVKFDMSFVQGEEEDSKIPVTLGIKKKNLYLSCVKKGDKPTLQLEMVDPKKYPKNKEMEKRFVFEKHEIGNKNEFESAAYPNWFISTSQEEDRPVFLGNGPPGQDITDFQMQ

SEQ ID NO: 128 - protein, 140 aa, Homo sapiens
LNDANQKSLVLANPNYLKALHLNGLNQEVKFDMSFVQGEPHDSKIPVTLGISGTNLYLSCVKEGDEPVLQLEMVEPPKYIKNSEMDKRFFFEKTEIGSKVYFESAAYPNWFIATKQEEDRPVFLANGPPESDITDFQIEE

SEQ ID NO: 129 - protein, 522 aa, Homo sapiens
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 130 - protein, 522 aa, Homo sapiens
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQPVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 131 - protein, 530 aa, Mus musculus
MSLLNCENSCGSSQSSSDCCAAMAASCSAAVKDDSVSGSASTGNLSSSFMEEIQGYDVEFDPPLESKYECPICLMALREAVQTPCGHRFCKACIIKSIRDAGHKCPVDNEILLENQLFPDNFAKREILSLTVKCPNKGCLQKMELRHLEDHQVHCEFALVNCPQCQRPFQKCQVNTHIIEDCPRRQVSCVNCAVSMAYEEKEIHDQSCPLANIICEYCGTILIREQMPNHYDLDCPTAPIPCTFSVFGCHQKMQRNHLARHLQENTQLHMRLLAQAVHNVNLALRPCDAASPSRGCRPEDPNYEETIKQLESRLVRQDHQIRELTAKMETQSMYVGELKRTIRTLEDKVAEMEAQQCNGIYIWKIGKFGMHLKSQEEERPVVIHSPGFYTGRPGYKLCMRLHLQLPTAQRCANYISLFVHTMQGEYDSHLPWPFQGTIRLTILDQSEALIRQNHEEVMDAKPELLAFQRPTIPRNPKGFGYVTFMHLEALRQGTFIKDDTLLVRCEVSTRFDMGGLRKEGFQPRSTDAGV

SEQ ID NO: 132 - protein, 399 aa, Homo sapiens [sequence omitted]

SEQ ID NO: 133 - protein, 225 aa, Homo sapiens
MWLLNEKWSVVLDTYSLKSNCHLECVLPSWSEHLRYISKVAQYIHPYYPDEILRNSVSSAVVVLSHHHRHHCFRKEDQVGAPWLSRVVRLPAWFGRPPRALERASDNQVTISLLNCENRCGSSQSQSDYCVAMASSCSAATKNDSVGRTASTGNLFSSFMEEIQGYDVEFGPPLESKYECPICLMALREAVQTPCSHRFCKACIIKSIRDAGHKYPVDNEILLEN

SEQ ID NO: 134 - protein, 106 aa, Homo sapiens
KEGEEYYTSPVEERFGIPWRLRIYRNGGFLGLYLHCLKGEKDSNLKWSIEAEFTLKLVSDNGKSLTKKPKHVFEKPTGEGWGKFISWDDLEDDYLVDDTLIIEAEV

SEQ ID NO: 135 - protein, 57 aa, Homo sapiens
HEKTCPFVPVPCPNKCGKKILREDLPDHLSADCPKRPVPCPFKVYGCKVDMVRENLQ

SEQ ID NO: 136 - protein, 98 aa, Homo sapiens
SHTFKNVSKFEEGESYFSPSEEHFNIPWRLKIYRKNGFLSLYLHCEKEENDSRKWSIEAEFTLKLVSQNGKSLSKKDTHVFEKPGGWGFSKFISWDDL

SEQ ID NO: 137 - protein, 36 aa, Homo sapiens
CPICLEEYLKDPVVLPCGHTFCRSCIRKWLESSNSN

SEQ ID NO: 138 - protein, 695 aa, Homo sapiens [sequence omitted]

SEQ ID NO: 139 - protein, 318 aa, Homo sapiens
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLRSSYHTAEQDMMVSAFYTIFTPVLNPLIYSLRNKDVTRALRSMMQSRMNQEK

SEQ ID NO: 140 - protein, 365 aa, Homo sapiens
MANHTGRLDFILMGLFRQSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTGFSHIPEQKQAVSVFCTVLTPMLNPLIYILRNKDVVGLFRKFWEHIKSLNRTHKYQCGKQR

SEQ ID NO: 141 - protein, 348 aa, Homo sapiens
MDNITWMASHTGWSDFILMGLFRQSKHPMANITWMANHTGWSDFILLGLFRQSKHPALLCVVIFVVFLMALSGNAVLILLIHCDAHLHTPMYFFISQLSLMDMAYISVTVPKMLLDQVMGVNKISAPECGMQMFFYVTLAGSEFFLLATMAYDRYVAICHPLRYPVLMNHRVCLFLSSGCWFLGSVDGFTFTPITMTFPFRGSREIHHFFCEVPAVLNLSCSDTSLYEIFMYLCCVLMLLIPVVIISSSYLLILLTIHGMNSAEGRKKAFATCSSHLTVVILFYGAAIYTYMLPSSYHTPEKDMMVSVFYTILTPVVNPLIYSLRNKDVMGALKKMLTVEPAFQKAME

SEQ ID NO: 142 - protein, 217 aa, Homo sapiens
LMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLPSSYHTAEQDMMVSAFYTIFTPV

SEQ ID NO: 143 - protein, 253 aa, Homo sapiens
GNLLVILVILRTKKLRTPTNIFLLNLAVADLLFLLTLPPWALYYLVGGDWVFGDALCKLVGALFVVNGYASILLLTAISIDRYLAIVHPLRYRRIRTPRRAKVLILLVWVLALLLSLPPLLFSWLRTVEEGNTTVCLIDFPEESVKRSYVLLSTLVGFVLPLLVILVCYTRILRTLRKRARSQRSLKRRSSSERKAAKMLLVVVVVFVLCWLPYHIVLLLDSLCLLSIWRVLPTALLITLWLAYVNSCLNPII

SEQ ID NO: 144 - protein, 529 aa, Homo sapiens
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPHPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 145 - protein, 528 aa, Homo sapiens
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 146 - protein, 528 aa, Homo sapiens
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYLSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLLADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 147 - protein, 528 aa, Homo sapiens [sequence omitted]

SEQ ID NO: 148 - protein, 529 aa, Macaca fascicularis
MSVKWTSVILLIQLSFYFSSGSCGKVLVWAAEYSHWMNMKTILEELVQRGHEVTVLASSASILFDPNNSSALKIEVFPTSLTKTEFENIIRQQIKRWSELPKDTFWLYFSQMQEIMWKFGDITRNFCKDVVSNKKLMKKLQKSRFDVVFADAIFPCSELLAELLNTPLVYSLRFTPGYNFEKHCGGFLFPPSYVPVVMSELSDHMTFMERVKNMIYMLYFDFCFQIYAMKKWDQFYSEVLGRPTTLSETMGKADIWLIRNSWNFQFPHPLLPNVDFVGGLHCKPAKPLPKEMEEFVQSSGENGVVVFSLGSMVTNMKEERANVIASALAQIPQKVLWRFDGKKPDTLGLNTRLYKWIPQNDLLGHPKTRAFITHGGSNGIYEAIYHGVPMVGIPLFADQPDNIAHMKAKGAAVRLDFDTMSSTDLVNALKTVINDPLYKENVMKLSRIQHDQPVKPLDRAVFWIEFVMRHKGAKHLRPAAHDLTWFQYHSLDVIGFLLACVATVIFIIMKCCLFCFWKFARKGKKGKSD

SEQ ID NO: 149 - protein, 501 aa, Homo sapiens
GKVLVWPMDGSHWMNMKGILLELVQRGHEVTVLRPSASILIGPAKPSNLKFETYPDSATKEELENLFPKRVMNWFMEAAEAGTVWSYFSALQEYSDGARVSCKELVGNKFLMTKLQESSFDVVLADPVWPCGALLAELLHIPTVYSLRFVPGYAAEKADGGLPAPPSYVPVRLSDLSDGMTFGERVKNMLIMLYFDFWFQRFPKKWDQFASELLGRPVTLPEDLSKASAWLLRNYWDLEFPRPLLPNMEFIGGLNCKPAKPLPQEMEAFVQSSGEHGVVVFSLGSMVSNIPEEKANEIASALAQIPQKVLWRFDGTKPSTLGNNTRLVKWLPQNDLLGHPKTRAFVTHAGSNGVYEAICHGVPMVGMPLFGDQMDNAKHMEAKGAAVTLNVLTMTSEDLLNALKTVINDPSYKENIMRLSSIHHDQPVKPLDRAVFWIEFVMRHKGAKHLRPAAHDLTWYQYHSLDVIGFLLACVATVAFITFKCCLFGYRKFVGKKKRVK

SEQ ID NO: 150 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 151 - protein, 342 aa, Rattus norvegicus
MALRVGLGLGQLEALFVLLLIGLLQSRIGADGTEASCGAVIQPRITGGGSAKPGQWPWQVSITYNGVHVCGGSLVSNQWVVSAAHCFPREHSKEEYEVKLGAHQLDSFSNDIVVHTVAQIISHSSYREEGSQGDIALIRLSSPVTFSRYIRPICLPAANASFPNGLHCTVTGWGHVAPSVSLQTPRPLQQLEVPLISRETCSCLYNINAVPEEPHTIQQDMLCAGYVKGGKDACQGDSGGPLSCPIDGLWYLAGIVSWGDACGAPNRPGVYTLTSTYASWIHHHVAELQPRVVPQTQESQPDGHLCNHHPVFNLAAAQKLSRPILFLPLSLTLGLFSLWLEH

SEQ ID NO: 152 - protein, 342 aa, Rattus norvegicus
MALRVGLGLGQLEALFILLLIGLLQSRIGADGTEASCGAVIQPRITGGGSAKPGQWPWQVSITYNGVHVCGGSLVSNQWVVSAAHCFPREHSKEEYEVKLGAHQLDSFSNDIVVHTVAQIISHSSYREEGSQGDIALIRLSSPVTFSRYIRPICLPAANASFPNGLHCTVTGWGHVAPSVSLQTPRPLQQLEVPLISRETCSCLYNINAVPEEPHTIQQDMLCAGYVKGGKDACQGDSGGPLSCPIDGLWYLAGIVSWGDACGAPNRPGVYTLTSTYASWIHHHVAELQPRAVPQTQESQPDGHLCNHHPVFNLAAAQKLSRPILFLPLSLTLGLFSLWLEH

SEQ ID NO: 153 - protein, 339 aa, Mus musculus
MALRVGLGLGQLEAVTILLLLGLLQSGIRADGTEASCGAVIQPRITGGGSAKPGQWPWQVSITYDGNHVCGGSLVSNKWVVSAAHCFPREHSREAYEVKLGAHQLDSYSNDTVVHTVAQIITHSSYREEGSQGDIALIRLSSPVTFSRYIRPICLPAANASFPNGLHCTVTGWGHVAPSVSLQTPRPLQQLEVPLISRETCSCLYNINAVPEEPHTIQQDMLCAGYVKGGKDACQGDSGGPLSCPMEGIWYLAGIVSWGDACGAPNRPGVYTLTSTYASWIHHHVAELQPRVVPQTQESQPDGHLCNHHPVFSSAAAPKLLRPVLFLPLGLTLGLLSLA

SEQ ID NO: 154 - protein, 342 aa, Mus musculus
MAPRVGLGLGQLEAVTILLLLGLLQSGIRADGTEASCGAVIQPRITGGGSAKPGQWPWQVSITYDGNHVCGGSLVSNKWVVSAAHCFPREHSREAYEVKLGAHQLDSYSNDTVVHTVAQIITHSSYREEGSQGDIAFIRLSSPVTFSRYIRPICLPAANASFPNGLHCTVTGWGHVAPSVSLQTPRPLQQLEVPLISRETCSCLYNINAVPEEPHTIQQDMLCAGYVKGGKDACQGDSGGPLSCPMEGIWYLAGIVSWGDACGAPNRPGVYTLTSTYASWIHHHVAELQPRVVPQTQESQPDGHLCNHHPVFSSAAAPKLLRPVLFLPLGLTLGLLSLWLEH

SEQ ID NO: 155 - protein, 230 aa, Homo sapiens
RIVGGSEANIGSFPWQVSLQYRGGRHFCGGSLISPRWVLTAAHCVYGSAPSSIRVRLGSHDLSSGEETQTVKVSKVIVHPNYNPSTYDNDIALLKLSEPVTLSDTVRPICLPSSGYNVPAGTTCTVSGWGRTSESSGSLPDTLQEVNVPIVSNATCRRAYSGGPAITDNMLCAGGLEGGKDACQGDSGGPLVCNDPRWVLVGIVSWGSYGCARPNKPGVYTRVSSYLDWI

SEQ ID NO: 156 - protein, 217 aa, Homo sapiens
IVGGREAQAGSFPWQVSLQVSSGHFCGGSLISENWVLTAAHCVSGASSVRVVLGEHNLGTTEGTEQKFDVKKIIVHPNYNPDTNDIALLKLKSPVTLGDTVRPICLPSASSDLPVGTTCSVSGWGRTKNLGTSDTLQEVVVPIVSRETCRSAYGGTVTDTMICAGALGGKDACQGDSGGPLVCSDGELVGIVSWGYGCAVGNYPGVYTRVSRYLDWI

SEQ ID NO: 157 - protein, 980 aa, Mus musculus
MAAATASSALKRLDLRDPNALFETHGAEEIRGLERQVRAEIEHKKEELRQMVGERYRDLIEAADTIGQMRRCAEGLVDAVQATDQYCARLRQAGSVAPRVPRAPQPQPPSEKFYSMAAQIKLLLEIPEKIWSAMEASQHLQATQLYLLCCHLHSLLQLDSSNSRYSPILSRFPILIRQVAAASHFRSTILHESKMLLKCQAVSDQAVAEALCSIMLLEESSPRQALTDFLLARKATIQTLLNQSHHGAGIKAQICSLVELLATTLNQAHALFYTLPEGVLPDPSLPCGLLFSTLETVTRQHPTGKGIGALQGEMKLCSWLRHLPTSIIEFQPTLRTLAHPISQEYLKDTLQKWIDMCNEDIKNGIGNLLMYVKSMKGLAGIRDAIWDLLSNESASHSWEVVCQRLLEKPLLFWEDLMQQLFLDRLQTLTREGFESISNSSKELLVSALQELETNNSTSNKHVHFEQNMSFFLWSESPNDLPSDAAWVSVANRAQFASSGLSMKAQAISPCVQNFCSALDSKLKVKLDDLLAYLPSSDTPLLKDTTPTHQPKNSAFDRYADTGTVQDMLRTQSVACIKSVVGCIQAELCTIEEVTREQKDVLHSTKLHAVLFMARLCQSLGELCPHLKQCIVGQCGGSEKPAREARALKKQGKGRAQDVLPAQAQWQGVKEVLLQQSVMAYRVWSTALVKFLICGFTRSLLLRDAGSVLATATNWDELEIQEGTESGSSVTSKIRLPTQPSWYVQSFLFSLCQEVNRVGGHALPKVTLQEMLETCMAQVIAAYEQLTEENQIKKEGAFPMTQNRALQLLYDLRYLTMVLSSKGEEVKSGRSKADSRMEKMTERLEALIDPFDLDVFTPHLNSNLNRLVQRTSVLFGLVTGTENQFASRSSTFNSQEPHNILPLASSQIRFGLLPLSMTSTRKARATSRSVETQAQVGPPALSRVGDPTTHPGSLFRQLASEEDDSPAPSLFKLAWLSSMTK

SEQ ID NO: 158 - protein, 961 aa, Homo sapiens
ATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIPDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVGAKSKRLIRGWVPTSHRATHDQLPFK

SEQ ID NO: 159 - protein, 962 aa, Homo sapiens [sequence omitted]

SEQ ID NO: 160 - protein, 438 aa, Homo sapiens
LPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 161 - protein, 1068 aa, Arabidopsis thaliana
MRMSSASAGEYRPSAVSLSSNGGGQRDAESLFRTKPMSEIRIVESATRKNIEDKKEELRQLVGTRYRDLIDSADSIVHMKSLCESISANISSIHGNIRSLSSSSVAETPKLASLNPVRVNVYGIACRVKYLVDTPENIWGCLDESMFLEAAGRYMRAQHVQQRLIKLEGCGGGVAEVDQSKLLANFPLLEHQWQIVESFKAQISQRSHERLLDPGLGLGAYVDALTAVAVVDELDPEQVLELFLDSRKTWILQKLNACTGEDAGEVVLVFCDVLSVIQVTVGQVGELFLQALTDMPLFYKTILSTPPASQLFGGIPNPEEEVELWKSFRDKLESVMLILDKNDVSKSCLTWLRECGGQIVGKVSGKHLIEAIVTGAELGSAEKLIRETMDSKDVLRGSLDWLKSVFGSEVELPWNRIRELVLGDDLNLWDEIFEKAFVERMKSIIDSKFENLTKAVNVADSVHAYSEITGEKINFQAYLNRPSTGGGVWFIEPNSKKVGLISGNKSSPEESDFQSCLTAYFGPEVSQMRDAVDRRCHSVLEDLLSFFESEKAGPRLKDLAPYVQNKCYDSVSALLADVDKELEFLCAAVKKENKDSEAIPPAIIIEKSLFMGRLLFALLNHSKHVPLILGSPRLWCRETMTAVSDKLSSLLRQPRFSSNTPATADSPGKQLHTDLRKQTSLAVAALLGAEEKTSPKFEELNRTMRDLCIKAHTLWIKWLSDELSAILLRDLRSDDGLSATTPLRGWEETIVKQEQDESQSELKISLPSLPSLYMISFLCRASEEIHRIGGHVLDRSILQKFASSLLEKITIIYEDFLSAREASEPQISEKGVLQILLDLRFAADVLSGGDTSTNVETPKSTINRSAYRRRQDQQKTKLVNRGRIDGVTSQLTQKLDPIDWLTYEPYLWENEKQSYLRHAVLFGFFVQLNRMYTDTAQKLSINIESNIMPCSTVPRFKYLPISAPALSSRSTNKVSIPVTSNDASARNSWKAFTNGEQSQTSDLEENSNFGVAFKSFMQESTLKLGSILTDGQVGIFKDRSAAAMSTFGDILPAQAAGLLSSFTNTRSE

SEQ ID NO: 162 - protein, 557 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 163 - protein, 538 aa, Homo sapiens
GNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 164 - protein, 558 aa, Mus musculus
MAHSEEQAAVPCAFIRQNSGNSISLDFEPDTEYQFVEQLEERYKCAFCHSVLHNPHQTGCGHRFCQQCIRSLRELNSVPICPVDKEVIKPQEVFKDNCCKREVLNLHVYCKNAPGCNARIILGRFQDHLQHCSFQAVPCPNESCREAMLRKDVKEHLSAYCRFREEKCLYCKRDIVVTNLQDHEENSCPAYPVSCPNRCVQTIPRARVNEHLTVCPEAEQDCPFKHYGCTVKGKRGNLLEHERAALQDHMLLVLEKNYQLEQRISDLYQSLEQKESKIQQLAETVKKFEKELKQFTQMFGRNGTFLSNVQALTSHTDKSAWLEAQVRQLLQIVNQQPSRLDLRSLVDAVDSVKQRITQLEASDQRLVLLEGETSKHDAHINIHKAQLNKNEERFKQLEGACYSGKLIWKVTDYRVKKREAVEGHTVSVFSQPFYTSRCGYRLCARAYLNGDGSGKGTHLSLYFVVMRGEFDSLLQWPFRQRVTLMLLDQSGKKNHIVETFKADPNSSSFKRPDGEMNIASGCPRFVSHSTLENSKNTYIKDDTLFLKVAVDLTDLEDL

SEQ ID NO: 165 - protein, 558 aa, Mus musculus
MAHSEEQAAVPCAFIRQNSGNSISLDFEPDTEYQFVEQLEERYKCAFCHSVLHNPHQTGCGHRFCQQCIRSLRELNSVPICPVDKEVIKPQEVFKDNCCKREVLNLHVYCKNAPGCNARIILGRFQDHLQHCSFQAVPCPNESCREAMLRKDVKEHLSAYCRFREEKCLYCKRDIVVTNLQDHEENSCPAYPVSCPNRCVQTIPRARVNEHLTVCPEAEQDCPFKHYGCTVKGKRGNLLEHERAALQDHMLLVLEKNYQLEQRISDLYQSLEQKESKIQQLAETVKKFEKELKQFTQMFGRNGTFLSNVQALTSHTDKSAWLEAQVRHLLQIVNQQPSRLDLRSLVDAVDSVKQRITQLEASDQRLVLLEGETSKHDAHINIHKAQLNKNEERFKQLEGACYSGKLIWKVTDYRVKKREAVEGHTVSVFSQPFYTSRCGYRLCARAYLNGDGSGKGTHLSLYFVVMRGEFDSLLQWPFRQRVTLMLLDQSGKKNHIVETFKADPNSSSFKRPDGEMNIASGCPRFVSHSTLENSKNTYIKDDTLFLKVAVDLTDLEDL

SEQ ID NO: 166 - protein, 568 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSELSAHLSECVNAPSTCSFKRYGCVFQGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 167 - protein, 107 aa, Homo sapiens
EGEEYYTSPVEERFGIPWRLRIYRNGGFLGLYLHCLKGEKDSNLKWSIEAEFTLKLVSDNGKSLTKKPKHVFEKPTGEGWGKFISWDDLEDDYLVDDTLIIEAEVKI

SEQ ID NO: 168 - protein, 57 aa, Homo sapiens; identical to SEQ ID NO: 135

SEQ ID NO: 169 - protein, 100 aa, Homo sapiens
VLSHTFKNVSKFEEGESYFSPSEEHFNIPWRLKIYRKNGFLSLYLHCEKEENDSRKWSIEAEFTLKLVSQNGKSLSKKDTHVFEKPGGWGFSKFISWDDL

SEQ ID NO: 170 - protein, 40 aa, Homo sapiens
CPICLEEYLKDPVVLPCGHTFCRSCIRKWLESSNSNTCPI

SEQ ID NO: 171 - protein, 175 aa, Bos taurus
MSSQIRQNYSTEVEAAVNRLVNMQLRASYTYLSLGFYFDRDDVALEGVGHFFRELAKEKREGAERLLKLQNQRGGRALFLDVQKPSQDEWGKTQDAMEAALLVEKNLNQALLDLHGLASARGDPHICDFLENHFLDEEVKLIKKMGDHLTNLRRLAGPQAGLGEYLFERLTLKHD

SEQ ID NO: 172 - protein, 175 aa, Cavia porcellus
MTSQIRQNYSTEVEAAVNRLVNLHLQASYTYLSLGYYFDRDDVALAGVGHFFRELAKEKREGAERLLKTQNQRGGRALFQDVQKPSEDEWGKTLDAMEAALTLEKSLNQALLDLHALGSAKTDSHVCDFLENHFLDEEVKLIKKIGDHLTNLRRLDGPQAGLGEYLFERLTLKHD

SEQ ID NO: 173 - protein, 183 aa, Rattus norvegicus
MTSQIRQNYSTEVEAAVNRLVNLHLRASYTYLSLGFFFDRDDVALEGVGHFFRELAEEKREGAERLLKLQNERGGRALFQDVQKPSQDEWGKTLEAMKAALALEKNLNQALLDLHALGSAQADPHLCDFLESHFLDKEVKLIKKMGNHLTNLRRWQGPQPAQTGVAQASLGEYLFERLTLKHD

SEQ ID NO: 174 - protein, 175 aa, Equus caballus
MSSQIRQNYSTEVEAAVNRLVNLYLRASYTYLSLGFYFDRDDVALEGVCHFFRELAEEKREGAERLLKMQNQRGGRALFQDLQKPSQDEWGTTPDAMKAAIVLEKSLNQALLDLHALGSAQADPHLCDFLESHFLDEEVKLIKKMGDHLTNIQRLVGSQAGLGEYLFERLTLKHD

SEQ ID NO: 175 - protein, 183 aa, Mus musculus
MTSQIRQNYSTEVEAAVNRLVNLHLRASYTYLSLGFFFDRDDVALEGVGHFFRELAEEKREGAERLLKLQNERGGRALFQDVQKPSQDEWGKTLEAIQAALRLEKNLNQALLDLHALGSARTDPHLCDFLESHFLDKEVKLIKKMGNHLTNLRRVAGPQPVQTGVAQASLGEYLFERLTLKHD

SEQ ID NO: 176 - protein, 121 aa, Homo sapiens
EAALNRQINLELYASYVYLSMAAYFDRDDVALPGFAKFFREASHEEREHAEKLMKYQNKRGGRVVLQDIKKPEKDEWGSGLEAMQTALQLEKSVNQSLLELHKVATDNNDPHLCDFLESEY

SEQ ID NO: 177 - protein, 257 aa, Homo sapiens
SKGFPIILAGRPPLGFPTSDPTEVFILFSNPSLLFPVSVCSERCSERCSHSPRLPPHPPHFPPPQCVNGVLTPSSTLSPFPPPEWDLLFPRVVLSRGAAAGPPLVFLLETGAFRESAGARANRSQRGVSDTSPASHQGELAVCDAVSVWVTDPWTAVDLGVLEVEVLGEVPAAVGSSLRQHFFVARFEADKSEEGGPGVGGGAAAGVWTGGHWVSECKAKQSYVRALTADAQGRVDWRWIQIGTACVCTLLSRTGRA

SEQ ID NO: 178 - protein, 257 aa, Homo sapiens
SKGFPIILAGRPPLGFPTSDPTEVFIFFPNPSLLFPVSMCSERCSERCSCSPRLPPHPPHFPPPQCVIGVLTPSSTLSRFPPPEWDLLFPRVVLSRGAAAGPPLVFLLETGAFRESAGARANRSQRGVSDTSPVSHQGELAVCDAVTVWVTDPWTAVDLGVLEVEVLGEVPAAGSSSLRQHFFVTRFEADKSKEGGPGVGGGPAAGVWTGGHWVSECKAKQSYGRALTTDAQGRVDWRWIQIGTACVCTLLSRTGRA

SEQ ID NO: 179 - protein, 210 aa, Homo sapiens
MLLLPQAPSASPSFSSSPCVIGVLTPSSTLSRFPPPEWDLLFPRVVLSRGAAAGPPLVFLLETGAFRESAGARANRSQRGVSDTSPVSHQGELAVCDAVTVWVTDPWTAVDLGVLEVEVLGEVPAAGSSSLRQHFFVTRFEADKSKEGGPGVGGGPAAGVWTGGHWVSECKAKQSYGRALTTDAQGRVDWRWIQIGTACVCTLLSRTGRA

SEQ ID NO: 180 - protein, 186 aa, Homo sapiens
PPPLTLSPFPPPEWDLIFPQVVLSRGAAAGPPLVFLLETGAFWESAGTRANRSQRGVSDTSPASHQGELAVCDAVSVWVTDPRTAVDLVVLEVEVLGEVPAAGSSSLHQHFFVTCFKADNSEEGGPGVGGGAAAGVWTGGHWVSECKAKQSYVRALTADAQGRVDWRWIQTGTACVCTLLSRTGRA

SEQ ID NO: 181 - protein, 210 aa, Homo sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 182 - protein, 95 aa, Homo sapiens
ASRRGELSVCDSVSVWVTDKTTAVDIRGKEVTVLGEVNTNNGPLKQYFFETKCKPPGPVGSGCRGIDKRHWNSECKTTQTYVRALTMDANKRVGW

SEQ ID NO: 183 - protein, 94 aa, Homo sapiens
SHRGEYSVCDSVSVWVTDKTTATDISGKEVTVLGEVPVNNGPLKQYFFETRCKSPNPVKSGCRGIDSRHWNSHCTTTQTYVRALTSDANQRVGW

SEQ ID NO: 184 - protein, 335 aa, Mus musculus
MAAPIGVPLLVRGGCQRILSSPLNHIYLHKRSGSQQRRHFFFWRQRDISHSVVSPAAVSPAHPVPKRIKKPDYVTTGIVPDWGDSIEVKDEDQIQGLREACRLARHVLLLAGKSLKVDMTTEEIDALVHWEIIRHDAYPSPLGYGRFPKSVCTSVNNVLCHGIPDSRPLQDGDIINIDVTVYYNGYHGDTSETFLVGNVDESGKKLVEVARRCRDEAIAACRAGAPFSVIGNTISRITHQNGLQVCPHFVGHGIGSYFHGHPEIWHHANDNDLPMEEGMAFTIEPIITEGSPEFKVLEDAWTVVSLDNQRSAQFEHTVLITPRGVEILTKLPQEA

SEQ ID NO: 185 - protein, 217 aa, Mus musculus
MTTEEIDALVHWEIIRHDAYPSPLGYGRFPKSVCTSVNNVLCHGIPDSRPLQDGDIINIDVTVYYNGYHGDTSETFLVGNVDESGKKLVEVARRCRDEAIAACRAGAPFSVIGTTISRITHQNGLQVCPHFVGHGIGSYFHGHPEIWHHANDNDLPMEEGMAFTIEPIITEGSPEFKVLEDAWTVVSLDNQRSAQFEHTVLITPRGVEILTKLPQEA

SEQ ID NO: 186 - protein, 369 aa, Arabidopsis thaliana
MASSVFLSSFSSSSSLQLCSSFHGEYLAPSRCFLGAPVTSSSLSLSGKKNSYSPRQFHVSAKKVSGLEEAIRIRKMRELETKSKVRRNPPLRRGRVSPRLLVPDHIPRPPYVESGVLPDISSEFQIPGPEGIAKMRAACELAARVLNYAGTLVKPSVTTNEIDKAVHDMIIEAGAYPSPLGYGGFPKSVCTSVNECMCHGIPDSRQLQSGDIINIDVTVYLDGYHGDTSRTFFCGEVDEGFKRLVKVTEECLERGIAVCKDGASFKKIGKRISEHAEKFGYNVVERFVGHGVGPVFHSEPLIYHYRNDEPGLMVEGQTFTIEPILTIGTTECVTWPDNWTTLTADGGVAAQFEHTILITRTGSEILTKC

SEQ ID NO: 187 - protein, 369 aa, Arabidopsis thaliana
MASSVFLSSFSSSSSLQLCSSFHGEYLAPSRCFIGAPVTSSSLSLSGKKNSYSPRQFHVSAKKVSGLEEAIRIRKMRELETKSKVRRNPPLRRGRVSPRLLVPDHIPRPPYVESGVLPDISSEFQIPGPEGIAKMRAACELAARVLNYAGTLVKPSVTTNEIDKAVHDMIIEAGAYPSPLGYGGFPKSVCTSVNECMCHGIPDSRQLQSGDIINIDVTVYLDGYHGDTSRTFFCGEVDEGFKQLVKVTEECLEKGIAVCKDGASFKKIGKRISEHAEKFGYNVVERFVGHGVGPVFHSEPLIYHYRNDEPGLMVEGQTFTIEPILTIGTTECVTWPDNWTTLTADGGVAAQFEHTILITRTGSEILTKC

SEQ ID NO: 188 - protein, 307 aa, Drosophila melanogaster
MGSGLSLSGLYSDGYTYRDTGKYEQIVSTGQVSPERFVPEEIKKPAYYFKNMPPGNTLGSPEIKSQVQIDAMRLSGRLAARILRECGKLATVGTTTDQIDAFAHERILESKAYPSPLRYAGFPKSICTSINNIACHGIPDDRQLADGDIINIDVTVFLNGYHGDCSETFRVGNVDERGGFLVEATKSCLDQCISLCGPGVEFNEIGKFIDRYCDEHDLASIAAFIGHGIGSYFHGPPEILHYYNEIPGKMQPGMTFTIEPILSLGGAEIAVLQDGWTAISLDGARSAQFEHTILITETGTEILTRDQ

SEQ ID NO: 189 - protein, 240 aa, Homo sapiens
IKSPEEIEKMRKAGEIARRVHRAVVEAIKPGMTELEIAEEIEYAIRKRGGADPAFYGYIVIGFPTSISVNEAVAHYSPDDRVLKDGDIVLIDAGAEYDGYHGDIARTFPVGKPTPDARKLYEAVLEAQEAAIEAIKPGNTLSDIHAAIQKVAESELGQCKPVRHGLGHGIGLDVHDVPGVPQYDRGDTRVLEEGMVFTIEPGVYFGGVPGRTRGDGWVRIEDDIVVSEQGEETLTVTPNG

SEQ ID NO: 190 - DNA, 22 bp, Artificial Sequence
  Description of Artificial Sequence: PCR Primer
tgaccacagacatcatcagtgt

SEQ ID NO: 191 - DNA, 26 bp, Artificial Sequence
  Description of Artificial Sequence: PCR Primer
ccatcttgaaccatgcccactaccta

SEQ ID NO: 192 - DNA, 20 bp, Artificial Sequence
  Description of Artificial Sequence: PCR Primer
tcaatggtgaagtgcaggtt

SEQ ID NO: 193 - DNA, 22 bp, Artificial Sequence
  Description of Artificial Sequence: PCR Primer
tgaccacagacatcatcagtgt

SEQ ID NO: 194 - DNA, 26 bp, Artificial Sequence
  Description of Artificial Sequence: PCR Primer
ccatcttgaaccatgcccactaccta

SEQ ID NO: 195 - DNA, 20 bp, Artificial Sequence
  Description of Artificial Sequence: PCR Primer
tcaatggtgaagtgcaggtt

SEQ ID NO: 196 - DNA, 22 bp, Artificial Sequence
  Description of Artificial Sequence: PCR Primer
cacggaacgtatcttcaagaaa

SEQ ID NO: 197 - DNA, 26 bp, Artificial Sequence
  Description of Artificial Sequence: PCR Primer
ctgcacgtgtgaccctaactggactg

SEQ ID NO: 198 - DNA, 22 bp, Artificial Sequence
  Description of Artificial Sequence: PCR Primer
gccacagtccacagaacatatt

SEQ ID NO: 199 - DNA, 22 bp, Artificial Sequence
  Description of Artificial Sequence: PCR Primer
ggcttcctcatggtactcctta

SEQ ID NO: 200 - DNA, 26 bp, Artificial Sequence
  Description of Artificial Sequence: PCR Primer
ccgctggatctcttccaactggtact

SEQ ID NO: 201 - DNA, 21 bp, Artificial Sequence
  Description of Artificial Sequence: PCR Primer
acagtggggtgacatgtacct

SEQ ID NO: 202 - DNA, 22 bp, Artificial Sequence
  Description of Artificial Sequence: PCR Primer
tggactatgaagcaggagtcat

SEQ ID NO: 203 - DNA, 26 bp, Artificial Sequence
  Description of Artificial Sequence: PCR Primer
caatgtgaccaacaagtcccacatct

SEQ ID NO: 204 - DNA, 22 bp, Artificial Sequence
  Description of Artificial Sequence: PCR Primer
cagagaaattgtgggtgaaagt

SEQ ID NO: 205 - DNA, 20 bp, Artificial Sequence
  Description of Artificial Sequence: PCR Primer
aagcgagaaagccactaggt

SEQ ID NO: 206 - DNA, 23 bp, Artificial Sequence
  Description of Artificial Sequence: PCR Primer
acaccacagcggctcactccatt

SEQ ID NO: 207 - DNA, 20 bp, Artificial Sequence
  Description of Artificial Sequence: PCR Primer
gcaatacgcacgtggtagag

SEQ ID NO: 208 - DNA, 21 bp, Artificial Sequence
  Description of Artificial Sequence: PCR Primer
aagcgagaaagccactaggta

SEQ ID NO: 209 - DNA, 23 bp, Artificial Sequence
  Description of Artificial Sequence: PCR Primer
acaccacagcggctcactccatt

SEQ ID NO: 210 - DNA, 22 bp, Artificial Sequence
  Description of Artificial Sequence: PCR Primer
gtagagtcccagtctggaagct

SEQ ID NO: 211 - DNA, 22 bp, Artificial Sequence
  Description of Artificial Sequence: PCR Primer
tgaaatgcaacagctatcaaca

SEQ ID NO: 212 - DNA, 28 bp, Artificial Sequence
  Description of Artificial Sequence: PCR Primer
tccaactcttcagatactgaaagcaaca

SEQ ID NO: 213 - DNA, 20 bp, Artificial Sequence
  Description of Artificial Sequence: PCR Primer
tttgggaagtaggccagaac

SEQ ID NO: 214 - DNA, 22 bp, Artificial Sequence
  Description of Artificial Sequence: PCR Primer
agggactacagcctccagatac

SEQ ID NO: 215 - DNA, 26 bp, Artificial Sequence
  Description of Artificial Sequence: PCR Primer
atggcccatacacgtgttctgttcag

SEQ ID NO: 216 - DNA, 22 bp, Artificial Sequence
  Description of Artificial Sequence: PCR Primer
cattgttctgggtgtatgttga

SEQ ID NO: 217 - DNA, 22 bp, Artificial Sequence
  Description of Artificial Sequence: PCR Primer
gctggtaccttgtgttgacact

SEQ ID NO: 218 - DNA, 27 bp, Artificial Sequence
  Description of Artificial Sequence: PCR Primer
ccagcatattctacctgaagaatgcca

SEQ ID NO: 219 - DNA, 22 bp, Artificial Sequence
  Description of Artificial Sequence: PCR Primer
aaagccttttatgggtctttga

SEQ ID NO: 220 - DNA, 22 bp, Artificial Sequence
  Description of Artificial Sequence: PCR Primer
tcagccagaccatagagaatgt

SEQ ID NO: 221 - DNA, 25 bp, Artificial Sequence
  Description of Artificial Sequence: PCR Primer
atgctgaagcaccccaacatcattg

SEQ ID NO: 222 - DNA, 22 bp, Artificial Sequence
  Description of Artificial Sequence: PCR Primer
ctccttcagacatacccctctt

SEQ ID NO: 223 - DNA, 22 bp, Artificial Sequence
  Description of Artificial Sequence: PCR Primer
catagagaatgttcgccaagag

SEQ ID NO: 224 - DNA, 25 bp, Artificial Sequence
  Description of Artificial Sequence: PCR Primer
atgctgaagcaccccaacatcattg

SEQ ID NO: 225 - DNA, 22 bp, Artificial Sequence
  Description of Artificial Sequence: PCR Primer
ctccttcagacatacccctctt

SEQ ID NO: 226 - DNA, 21 bp, Artificial Sequence
  Description of Artificial Sequence: PCR Primer
gcatgtgtggagacagaagag

SEQ ID NO: 227 - DNA, 25 bp, Artificial Sequence
  Description of Artificial Sequence: PCR Primer
cttccctacagctggagcagccagt

SEQ ID NO: 228 - DNA, 22 bp, Artificial Sequence
  Description of Artificial Sequence: PCR Primer
accaagatagagctccatgatg

SEQ ID NO: 229 - DNA, 20 bp, Artificial Sequence
  Description of Artificial Sequence: PCR Primer
ggcatgtgtggagacagaag

SEQ ID NO: 230 - DNA, 25 bp, Artificial Sequence
  Description of Artificial Sequence: PCR Primer
cttccctacagctggagcagccagt

SEQ ID NO: 231 - DNA, 22 bp, Artificial Sequence
  Description of Artificial Sequence: PCR Primer
ccaagatagagctccatgatgt

SEQ ID NO: 232 - DNA, 22 bp, Artificial Sequence
  Description of Artificial Sequence: PCR Primer
gcaaaaccacgaagagataatg

SEQ ID NO: 233 - DNA, 25 bp, Artificial Sequence
  Description of Artificial Sequence: PCR Primer
caaaccagagctgcttgctttccag

SEQ ID NO: 234 - DNA, 22 bp, Artificial Sequence
  Description of Artificial Sequence: PCR Primer
ttacatagccaaaaccttttgg

SEQ ID NO: 235 - DNA, 22 bp, Artificial Sequence
  Description of Artificial Sequence: PCR Primer
ggctcattcgaaactactggta

SEQ ID NO: 236 - DNA, 26 bp, Artificial Sequence
  Description of Artificial Sequence: PCR Primer
tggaatttcctcgcccactcttacct

SEQ ID NO: 237 - DNA, 22 bp, Artificial Sequence
  Description of Artificial Sequence: PCR Primer
ggttgacaggtttgcagtagag

SEQ ID NO: 238 - DNA, 22 bp, Artificial Sequence
  Description of Artificial Sequence: PCR Primer
gtacactctggcctccagctat

SEQ ID NO: 239 - DNA, 26 bp, Artificial Sequence
  Description of Artificial Sequence: PCR Primer
ctcctggatccaaagcaaggactctg

SEQ ID NO: 240 - DNA, 22 bp, Artificial Sequence
  Description of Artificial Sequence: PCR Primer
gaatgggctcaaagatcaagat

SEQ ID NO: 241 - DNA, 22 bp, Artificial Sequence
  Description of Artificial Sequence: PCR Primer
agcagtgcagttgtgaaagttt

SEQ ID NO: 242 - DNA, 26 bp, Artificial Sequence
  Description of Artificial Sequence: PCR Primer
tgattcatggattcacccagtcatta

SEQ ID NO: 243 - DNA, 20 bp, Artificial Sequence
  Description of Artificial Sequence: PCR Primer
cagaactgagccagcatcat

SEQ ID NO: 244 - DNA, 21 bp, Artificial Sequence
  Description of Artificial Sequence: PCR Primer
gccagaaaggcaactattcag

SEQ ID NO: 245 - DNA, 26 bp, Artificial Sequence
  Description of Artificial Sequence: PCR Primer
aacttctcaaccagccacaccatggt

SEQ ID NO: 246 - DNA, 22 bp, Artificial Sequence
  Description of Artificial Sequence: PCR Primer
agcaactccactaatgagcaaa

SEQ ID NO: 247 - DNA, 22 bp, Artificial Sequence
  Description of Artificial Sequence: PCR Primer
aaaggacagtcttgctcagctt

SEQ ID NO: 248 - DNA, 26 bp, Artificial Sequence
  Description of Artificial Sequence: PCR Primer
caggacatacagccaggtgttcatct

SEQ ID NO: 249 - DNA, 22 bp, Artificial Sequence
  Description of Artificial Sequence: PCR Primer
ccaacaattgtgcgaagattat

SEQ ID NO: 250 - DNA, 23 bp, Artificial Sequence
  Description of Artificial Sequence: PCR Primer
ggtagatgaacacctggctgtat

SEQ ID NO: 251 - DNA, 33 bp, Artificial Sequence
  Description of Artificial Sequence: PCR Primer
cctgaagctgagcaagactgtccttttaagcac

SEQ ID NO: 252 - DNA, 24 bp, Artificial Sequence
  Description of Artificial Sequence: PCR Primer
taagtcagaaatcgttacagcaca

SEQ ID NO: 253 - DNA, 21 bp, Artificial Sequence
  Description of Artificial Sequence: PCR Primer
aattactgcaccgaagtggaa

SEQ ID NO: 254 - DNA, 25 bp, Artificial Sequence
  Description of Artificial Sequence: PCR Primer
ctgcgggcttcccttacctacctct

SEQ ID NO: 255 - DNA, 21 bp, Artificial Sequence
  Description of Artificial Sequence: PCR Primer
cggtagaaatggaggatgaga

SEQ ID NO: 256 - DNA, 20 bp, Artificial Sequence
  Description of Artificial Sequence: PCR Primer
cctctccagtgtgtcaatgg

SEQ ID NO: 257 - DNA, 25 bp, Artificial Sequence
  Description of Artificial Sequence: PCR Primer
gtcctaaccccaccctcgacattgt

SEQ ID NO: 258 - DNA, 20 bp, Artificial Sequence
  Description of Artificial Sequence: PCR Primer
aaggtcccactttggatcag

SEQ ID NO: 259 - DNA, 22 bp, Artificial Sequence
  Description of Artificial Sequence: PCR Primer
cgggaaatcatcagtcataatg

SEQ ID NO: 260 - DNA, 26 bp, Artificial Sequence
  Description of Artificial Sequence: PCR Primer
tccctcacctctaggctatggaggtt

SEQ ID NO: 261 - DNA, 22 bp, Artificial Sequence
  Description of Artificial Sequence: PCR Primer
tgacagagcacgttgtttacag

SEQ ID NO: 262 - DNA, 22 bp, Artificial Sequence
  Description of Artificial Sequence: PCR Primer
cgggaaatcatcagtcataatg

SEQ ID NO: 263 - DNA, 26 bp, Artificial Sequence
  Description of Artificial Sequence: PCR Primer
tccctcacctctaggctatggaggtt

SEQ ID NO: 264 - DNA, 22 bp, Artificial Sequence
  Description of Artificial Sequence: PCR Primer
tgacagagcacgttgtttacag

What is claimed is:

1. An isolated nucleic acid molecule comprising a nucleic acid sequence encoding a polypeptide comprising an amino acid sequence selected from the group consisting of:

(a) amino acids 21 to 533 of the amino acid sequence of SEQ ID NO: 28; and (b) the amino acid sequence SEQ ID NO. 28.

2. The nucleic acid molecule of claim 1, wherein said nucleic acid molecule comprises a nucleotide sequence SEQ ID NO: 27.

3. A vector comprising the nucleic acid molecule of claim 2.

4. The vector of claim 3, further comprising a promoter operably-linked to said nucleic acid molecule.

5. An isolated cell comprising the vector of claim 3.

* * * * *